United States Patent 12,577,609 (METHODS FOR CELL-TYPE SPECIFIC PROFILING TO IDENTIFY DRUG TARGETS) - sequence listing, part 8

SEQ ID NO: 9167 - DNA, 2715 bp, Homo sapiens
  ENST00000506455
acacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 9168 - DNA, 2992 bp, Homo sapiens
  ENST00000511108
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaa

SEQ ID NO: 9169 - DNA, 1540 bp, Homo sapiens
  ENST00000512983
tttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaat

SEQ ID NO: 9170 - DNA, 2552 bp, Homo sapiens
  ENST00000511507
acacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttaca

SEQ ID NO: 9171 - DNA, 577 bp, Homo sapiens
  ENST00000515602
gagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatga

SEQ ID NO: 9172 - DNA, 2631 bp, Homo sapiens
  ENST00000455639
atggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacagtgcggatttgcgaggcgcgccctggagctgctagagatccggaagcacagccccgaggtgtgcgaagccaccaatctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttc

SEQ ID NO: 9173 - DNA, 1273 bp, Homo sapiens
  ENST00000509901
atcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagct

SEQ ID NO: 9174 - DNA, 4352 bp, Homo sapiens
  ENST00000443668
agacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaaca

SEQ ID NO: 9175 - DNA, 4286 bp, Homo sapiens
  ENST00000393832
ggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaagtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaa

SEQ ID NO: 9176 - DNA, 4400 bp, Homo sapiens
  ENST00000296518
aggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacata

SEQ ID NO: 9177 - DNA, 1282 bp, Homo sapiens
  ENST00000515201
attcgcagtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaa

SEQ ID NO: 9178 - DNA, 2656 bp, Homo sapiens
  ENST00000513574
gacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtggacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 9179 - DNA, 1788 bp, Homo sapiens
  ENST00000621234
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtc

SEQ ID NO: 9180 - DNA, 1956 bp, Homo sapiens
  ENST00000398806
cttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcaga

SEQ ID NO: 9181 - DNA, 3393 bp, Homo sapiens
  ENST00000381163
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaaca

SEQ ID NO: 9182 - DNA, 2852 bp, Homo sapiens
  ENST00000381161
aatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaac

SEQ ID NO: 9183 - DNA, 624 bp, Homo sapiens
  ENST00000520904
agtgcgccgagccagggcaccgagtgctggggaatacaggccgtccaggcgcggcggggcgcggggagacggaggctgccggagcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggt

SEQ ID NO: 9184 - DNA, 566 bp, Homo sapiens
  ENST00000469234
gcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagc

SEQ ID NO: 9185 - DNA, 1293 bp, Homo sapiens
  ENST00000353656
atgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaa

SEQ ID NO: 9186 - DNA, 1158 bp, Homo sapiens
  ENST00000453106
tgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctctt

SEQ ID NO: 9187 - DNA, 731 bp, Homo sapiens
  ENST00000381157
gctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttggtcgacctggccgtctctgtttcccagatctccatcgaag

SEQ ID NO: 9188 - DNA, 2900 bp, Homo sapiens
  ENST00000639373
ttcgtagagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagc

SEQ ID NO: 9189 - DNA, 639 bp, Homo sapiens
  ENST00000382966
aggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagtctctccaaaaggtgcaagatatcatccagccacttggactgagagctcatcccaatccagttcctgatcagatggggccctgccactcgttccagccaggtgacctggtgttcgttaaaaagttccagaaagaaggactcctgcttagaaaagacctcatactgtcatccttaccaccccaatggctctaaaagtagaaaggaatgcttacattcatgacaccccctagtacaaagcatgtttaactgtaatctatgactaactaccctaattactggattggcagaaccctttttctccttctcttgtttagtcttccaaccattatatattaaaattagtttcttaaatttgt

SEQ ID NO: 9190 - DNA, 944 bp, Homo sapiens
  ENST00000493160
gccagaagagaagactcaactctttgcagaaaacagaaactgcctttgagtagagaagggctgagaaggaagatgctaaggatattctgaggggtgatcagaagattccttgagtgcaggggggcaggcaaggggtagaaagaaactgttgtcacagagtcataaaattctaagccactgcaatctccaggctggacttgattttgtgacagtgtctcctttttgtgggctgtagtgtagtgacaagttcttttgctgtttttccactccgtgcctttgctgaaagtctgccgcactggcacatgaagtggaaactccctctttgaatgcagcagcattggataattgtggatgttctgtggcgccgcaccacgacttgatcaccagttgtttcttcagggcaagggtctcactctgtcacccaggctggagtagagtggtacaatcacagctcactgcagcctcaaactcccaggctcaagtatcctcctacctcagcctcccaagtagctgtaactacagtgactgatcaggcttttgtcacactggccacagatgacatctactgccagggcgccctggtcctggggcagtcactgaggagacacaggctgacgaggaagctggtggtgttgatcactcctcaggtgtccagcctgctcagggtcttaccgtgttgcttaggctggagtgcagcggcaccgtcagggctcacagcagtcttgacctcccaggctcaagtcatcctcttgcctcagccccgctagtacctgggatgacagacttgcacgaccatgcacagggaacacgcagccttattgccacgtacctgtcctggggcaccttgccgcctgccagctggaccacaggagggaacacgtccatcaggctcgtgggctctccaatcactcagccagccaggagcaccctgggccagtggaaaa

SEQ ID NO: 9191 - DNA, 623 bp, Homo sapiens
  ENST00000357871
aggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagggacatggatgaagctggaaaccatgactctgagcaaactattgcagggatagaaaaccaaacactgcatgttctcactcataggtgggaattgaacaatgagaacacttggacacagggtggagaacatcacacactggagccagtcgtggggcggggagaggggggagggatagctttaggagatatacctaatgtaaatgatgagtaaacgggtgcagcacaccaacatggtacatgtatatatatgtatcaaacctgcacattgtgcacatgtaccctagaacttaaagtataataaaaaaaatttataaataaaaatgtttaggcaattaaaaaa

SEQ ID NO: 9192 - DNA, 694 bp, Homo sapiens
  ENST00000382963
ctgggcgcaggtctgcgggtccgcgcccactgcgtgcggcgccacggaccatgtcggggtctcactctgtcacccaggctggagtagagtggtacaatcacagctcactgcagcctcaaactcccaggctcaagtatcctcctacctcagcctcccaagtagctgtaactacagtgactgatcaggcttttgtcacactggccacagatgacatctactgccagggcgccctggtcctggggcagtcactgaggagacacaggctgacgaggaagctggtggtgttgatcactcctcaggtgtccagcctgctcagggtctcactcgtcgcccaggcttgagtgcagtgataccatctcggctcactgcaacctctccctcactggcccaagtgatcttccctcctcagccttctaagcagctgggaccacaagtatgtgcccgcatgcttggctatttttatttttattttttgtatttttggtagagacagggtttcgtcacattgcctaggctgatcttgaactcctggactcactcagtccacccaggttggcctcccaaagtgctgggattacaggcatgagccacggcgccctgccaaggagtctttttaaaaataatttccttttacaattccctttgtctttaattctcaaataaagcaaatacataaataaatgcatctaatgaa

SEQ ID NO: 9193 - DNA, 149 bp, Homo sapiens
  ENST00000382965
atgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcag

SEQ ID NO: 9194 - DNA, 3574 bp, Homo sapiens
  ENST00000323798
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatccca

SEQ ID NO: 9195 - DNA, 3378 bp, Homo sapiens
  ENST00000263276
cagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaa

SEQ ID NO: 9196 - DNA, 427 bp, Homo sapiens
  ENST00000594220
gtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccgggtaggacccccactttcctatcctctcctggcaaatcagcagctcctggctaggggtctttggtgcagggtgcagggtctcatcctacttgtaacagttgctgtccctttaagcaatgaaccaggccgatcgcgatggtggctcatggttgtaatcccagcactttgggaggcctaacaggaaggatcgcatgagctcaggagttaagagaccagcctgggcaacattttatttttactaaaaataaaaaaaaatcagccgag

SEQ ID NO: 9197 - DNA, 578 bp, Homo sapiens
  ENST00000472004
atgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtcagcgcccaggcccctgaggattctggaagggggcttgagaacagtgactcctggatcctgggaaggaggagcttgcacccttggagaccaggggcaccaggaaatgggggggctctcgggccgctgggagaggaggggtcctggtgccacagagtcctggagaccatgaagatct

SEQ ID NO: 9198 - DNA, 536 bp, Homo sapiens
  ENST00000496048
aaacaaactaactaaagaagcctaacagtaaatggcagctggtgtgtatgtgaccctgttgctctgcttcctccagggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgca

SEQ ID NO: 9199 - DNA, 459 bp, Homo sapiens
  ENST00000484289
caagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttggttagcagccctcgctccggcccctggcgcagcccactcccagatgcatgctttgggtcctgtgtttctcctagagtctcagttttttgttttgtttgt

SEQ ID NO: 9200 - DNA, 718 bp, Homo sapiens
  ENST00000457974
aggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaagggccccagaactatggacctcggccggggcctgccctcacacgcttgggcccacagtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgag

SEQ ID NO: 9201 - DNA, 4835 bp, Homo sapiens
  ENST00000338121
gttcctaccggcctggtccagcggacagcggctgcagcgggggcgccggctgggagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaac

SEQ ID NO: 9202 - DNA, 795 bp, Homo sapiens
  ENST00000424216
ggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggccca

SEQ ID NO: 9203 - DNA, 675 bp, Homo sapiens
  ENST00000461789
atgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtac

SEQ ID NO: 9204 - DNA, 390 bp, Homo sapiens
  ENST00000477239
atgtttcaggacttttgcccagcggaattcactgtaccagcatattaaagtccacacagatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcact

SEQ ID NO: 9205 - DNA, 4740 bp, Homo sapiens
  ENST00000377051
atggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaagg

SEQ ID NO: 9206 - DNA, 652 bp, Homo sapiens
  ENST00000598398
gagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaa

SEQ ID NO: 9207 - DNA, 558 bp, Homo sapiens
  ENST00000222304
aacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttgga

SEQ ID NO: 9208 - DNA, 2624 bp, Homo sapiens
  ENST00000593580
cggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacaggtgagagcccagtggcctgggtccttagcagggcagcagggatgggagagccaggcctcagcctagggcactggagacacccgagcactgagcagagctcaggacgtctcaggagtactggcagctgaacaggaaccaggacaggcacggtggctcatgcctgtaatcccagcactttgggaggttgaggcaggcagcccacttgaggtcagtttgagaccagcctggccaacatggtaaaaccccgtctctactaaaaatacaaaagttagccaggcttggtggcaggtgcctgtaatcccagctactcgggagactgaggcaggagaattgcttgaacccgcaaggtggaggttgcacagtgagctgagattgcaccactgcactccagcctggcaacagagcaagactccatctccaaaaaagaacagaaatcaatgaagcaccgagtgacagggactggaaggtcctaattccatgggtatttacggaacccctacgccgtgtggagtcttattctagacagtggggacgaggccatgaacaaggtagatgagagaggagatttctccatcctggtcagggaatttgttaaagactgatgaaaacatgaataaataattgtgtctagtacattctattcgtgaatctcataacagacagtggtagagtgaccgtgacccattcgccacacagtagagtcacttttttggtttgttttttagagacagggtcttcctctgttgctgaggctggagtgcagtggtgcagtcatagttcactgcagcctcaacctcctgtgctcaagcaatcctcccacctcagcgtcccaagtagctgggacagcaggcacatgccacgggttgggggaccacaggcatggtcaaggggctggcagtcaagcaagtgtttcatgagaaagtgacagttgaccttcgtcttggagggtgagagatggaggcagcaaagacctaaggagaggacaagccagcatagcccagggtcaggctgaacaagaggagatggtgggacttggggataaggctgaggggtgggcagtccctaagtcttgtgggcaaccatgcagacactgatttttccttggaataaagaggaagcccccataagcttttttttttttttctgagatagggtctcgctctgtcgttcaggctggtgtgcagtggcatcatctgggctcactgcaacctccgcctcccgggttcaagcaattctcctgcctcagcttcccgagcagctgggattacaggcggctgccaccacgcccggctaatttttgtttttttagtagagacagggtttcaccatgttggccagactggtcttgaactcctgacctcaggtgattctcccacctcggcttcccaaagtgctgggattacaggcgtgagccactgcgcccagcctcctgtaggtttttaaaatggagaaaaccacaatctcactggccatgttttaaaaaacttaatctgccagtcaggcaccatggctcacacctgtaatcccagagttttgggaggccaaggtaggaagatcagttgagcccaggagttcaagaccagcttgggcaacacaaccagaccccacctctacaaaaaattaaaaaattagccgggtgtggtggcgtgcacctgctgtcccagctactcgggaagctgaggcgggagcatcgcttgagcacaggaggtcaaggctgcagggagctatgactgtgccactgcactctggcctgggcaacagaggaagactctgtctaaaaaacaaacaaaaaaagtgactctgctgtgtggcaaatggattgaggggcaagaatgcagggaggtgtgttaggaggctggcactggcatccaggcaggggaaggtgatatcccaaagaagagtagcagctgtggaaagaggaggaggcggatctgggaggtttttttttttaggaaaagccgcccatgggaaggtgagcagaagcaagaaagcaaggcccctcctaagagtccatttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatggtgagcgcaacagtgatgcctttcctagccccctgctccctccccatgctaaggccggttccctgctcacattcccttccttcccacagcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttcc

SEQ ID NO: 9209 - DNA, 1771 bp, Homo sapiens
  ENST00000255039
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccggggggagggtgaggcggccgggggcattaactgacctctgagtacagcaataaaataacctggggatcttt

SEQ ID NO: 9210 - DNA, 719 bp, Homo sapiens
  ENST00000487988
attcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccaggtaagaccccagcccaggccagaatctgggggaggcttggggagactgcaagggtggggaaaggggaaagggcagttgttgcaggtacccagggactgaaagtcattgctgagaaggcaatggaggagagggttggggggctctggagaaagcatttggggagcagggtctgatgggcacttggggcagtgaggattgggggttcctgccactgt

SEQ ID NO: 9211 - DNA, 882 bp, Homo sapiens
  ENST00000456112
gggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccagg

SEQ ID NO: 9212 - DNA, 679 bp, Homo sapiens
  ENST00000482204
ggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccaggtaagaccccagcccaggccagaatctgggggaggcttggggagactgcaagggtggggaaaggggaaagggcagttgttgcaggtacccagggactgaaagtcattgctgagaaggcaatggaggagagggttggggggctctggagaaagcatttggggagcagggtctgatgggcacttggggcagtgaggattgggggttcctgccactgtggccccctctgcccagcatcccacccgggcccccactacctcctgccccccatccacgaggtcattcactctcatcgtggggccacggccacgctgccctgcgtcctgggcaccacgcctccca

SEQ ID NO: 9213 - DNA, 1022 bp, Homo sapiens
  ENST00000494218
atcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcgg

SEQ ID NO: 9214 - DNA, 4190 bp, Homo sapiens
  ENST00000303924
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtttatcaaaggttttgttctgtggcctgaatttactgggtcctacctacacattgaacatgttttgcctgtcttttttttttttttcaacttgccagttcactttacatgttagtataatgtttacacgggtgagttggataaattataaaacatataaattcaaaattggcagatagaatcaccaagtatctatcctcttttactttcaaatgaggaattttgtttttctgaattacacagatcatcacttcctatttcctgttctggacctgtataaaaatgtctacacagtagaagtgacatcaaggtttaataagtatatcaatgattggcacatataaaaattgttgaaccacatactctgaacttggctaatttagttactgcaaggcctccattatccagttttattttttacacgattgaccttgccttgtagctggtgctgtgtagacctgtgttgaaaacacaatcggaatatatgaataattgaataaacagcattatggtgaggcagagacacatggagaagtgttaaaaaaaaaatgggcttcctgcctttctgcctcttttttatgcagtcatctatgttacatctatcctgcctaagaaaaagctgcacatcctaccttcagagtacaaaaaggtacatctgagactcaagactctcactgattggagagcttgtggaaaacaaaacacaccatgccaataaatgagatgaaaacttgagtttgcctttttaactatttatgttctaagttaagctttgataacattcaaatgtcaaattctctcattcttataaaaagttgaattaattgcctgtatttattttagcaattattcaatgtatttccagtataggatgtatagtataattaattttttgtaaataaaatatttttgataaga

SEQ ID NO: 9215 - DNA, 9885 bp, Homo sapiens
  ENST00000303230
ccagccgcaccggagcccggaccgcagccactaagggcagcggcggcggcgggagccaggcgcgcagctagcagcggcgcggtcgggaagcagcagccgccgccgccgccgccgccgccgcgacgggcagctgggctcgccggcagccggctcgggcccctaccctctcggctacgtgtctccggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcactacttgcttggccaccgtaggagactagcattgccactgtttgttaagaatatcactaacctcaaacatgttcattgatctttcagaaagctgagggaaaattaatatttgtcttcatgtgttatcggacttttaccaagactcgatcaatgttagttgtaaataactttttcaacccaaataaaaatagctattctgtgttgtatgaaggtaaaagtcattgtttaagaatttagttttattgcttcacttcaaaacttagagttttaaattttacaaaacctgattgtgagaattattcaattgtaatgcaatggcttgaaacctacaatattattttaacctgcaatgttttatgcaaaattgtatgctcgaatctacaaattgcttgtattacaccaaaaatcgttacttttctttcttcttgccataatcaagcatctgaaaatagtccctgcatgcttctggggaaaaaaaaataggttcaaatcagtcattgtagagaaaggcttacagtatttctcgtttctagaaaagcataacaattcattaattgcctatcttataattcctataaggctgacttggatctctgacttaagtctagaagtgaggttttcacttttatttaatattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtaagaaagggattgttcagtctacctagaacctatgggaaagctgcaagaccatttacatatcagtacaaaactcctttattttattaaaatatgagaattaacttcaatttattaagattacgtattggtcctttaaattattaaaggtttacatttgataggattaatggatttggtagtgaaatatttttatatatataaatttttggttttttattttgagcactattgggaaacataagcaaaattgaaatgcatggtctttcagtgcaaccatacaatttttattcactttgtaatagaatggacaaaaaaactaaggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtgaagcccgtatgtatggagttttaatctgtacagaaagaaatgtattattcattggtctttctgctgctggaaagataatagaatagctgattcttacaacaactgtatgatcagggatgagttagagtatttcttttgtctttgctcaaagccatacatatataaatatatataaagattattaataaattcaacaaaaaataaactacaatcatgaatattttattttatcaatatatgctaatcaaatgttttattttattaatgagtacagctttgcctctatttttacatcataaaatttccaagagcttatacttgataatcacataaaatcaattatattctataattctggaatgagaggactttaaatagaacatggatttttcaaccacttctttgtttacctttttcgtatagtaaaatatgagcttattttcttttttgctctgtgcctttttagaatgtggttgttctccaacttcaaaacacaaccattttgtgtaattattggatatacagatgagaaataattttcctgtaataatggtaaataattgtcctgtaatatatttatacaaacctattttgttataatagttctatgacatacctattttgttataatagttttataacatacctattttgttataatagggccttgggctctattataacaaaacaggtttatataaatacattcatatttatagccttaaacaaaataggtttgtatagtaggcccaaggccctattataacaaaataggtttgtataaatatattcatatttatagccttgggccctgcaaagttatttggagagtgatagaacctccccacacaagtgggttttaaatgatacctaaaagcctgagatagagtttatcataatgagaataagtagtgaagcattcctgaaaacaaggaggataaatagtagcaatggcaatatattctattcaccaaaaaagtagcttgtctccaggtctggatgacctcttcataagtgaacaattccctgatgaatgctgttccactttaaagagatggttattttgcaatttataaacttaactgagcatactattttcaggacactacaaagtacatagtcaagttattaccgtcattcctataggacagagaatgatttaaacaatatgacatgtttaaaattttagatgatttatttcaaatcctgaattatgtctacttcaaattatgagcaatctctattatctttcaggactatttaaaaaatctccatacctcctctttcagcttaggtttttatatttgttaattttactatgttactttgcttctatggccctcacttgcactgtttataatgttaacctgtttgaatgagatatctctccattatatctttatctttttagaacatgtgccataaaacccatgtggttattttgttcatatgcactacaactagcaaacttttattttatgttcacctactttaaaaagtactcatactgtaccatgggaaagaaacatgggccttatagaatggaatgctgagctattttgagtcctgaaaacaatggccaaaaatttaaggaactgtggttgctgcatgcaccaaattgtagcacatacaaataaataaaatacagttctataactgtattcaatatggttattttcaaggaaaaataggatagaaattttctttgaaagatttgctattgtacttagggaagtacacctgctattacccctcaaaagcaatgactttcttaagcaatttcaatttttttcctttttaacaaccctgcacttgcacaaccctgcatctcttgtctcaccctaatgctgaccctgcttccaattcaggctttgacagggacaaatggagattttaaggttttttaatgagagaagccttgctgacactccccgcatcccaccttgaaaattatttaaagatgatcttaaaagaacctacagataatgctctgaatttgtttacaaggtccttgatgtggagagaatgagtaatacattaaatgctggggaaataattatcatttagtgaaaaattaagcatgcttttctaaaatgtggatgtttaacagagcacagctgattgggaacactggcagttcaatgcagctggagtgtctcacagggtgaagaggaacccagatcaagtgggaaatagggatttcaaaaaccttctgaaaggcttttaacatcagggcaaaggttttacagtgttgtactttatattcttaatttaagcttatcaacggggaggattcacattgaaatgtctgttttgctaatgtaacaaggaataaaataatttatgacacagcaaaaactgggggctatttacaaccccaccctgccttgtgaggatgctgggtcctaaggaaggtcctaggtttgctaaatagagtaatgggaataggaaactgaaagtttacttgctttgcgtaagataatatattgcggcagggaaggggtacaagaagataagagctagaacctgtgagaagggaaagaagtgataaaataattttggctaaaataaagcaagttctcaggccaggcgtggtggctcatgcctgtaatcctagcactttgggaggccaaagtgggaggaatgcttgaggccaggaattggagaccaaccagggcagcatgtcaagacctggtctctacaaggaaaaaaaatttttttaattgaccagtatatacttacatacctgcagtgtttagaaaacccgactataggtggtgtattcctgtagtcctagttactcagaaagttaaggcaggaggatcgcttgaacttaggaggtcaaggctgcagtgagccctgttcgttccactgcactccagcttgggggacagagcaaaaccctttctcaagaaaaacccaaacaaacaaaaaagtgaagccagttctttaatttctattggagatatcacacacgctccaaagagtggcaaaggtgaacattctttggagctattatatttctaatgtaacatcaatggccatttactcccaaagggaaacatctttttttttttttttttttaagatggagtctggctctgtcacccaggtgggagtgcaatggcaggatcttggcccactgcaacatcagcctcccaggtttaagcaattctcctgcatcagcctccagagtagctgggattacaggtgcccgccaccatggctagctaaatttttgtaatttttagtagagacagggttttaccatgttggccaggccggtctcgaacccctaacctcaagtgatccgcccgcctcaccctccagaagtgctaggattacaggcctgagccaccgcacccggccctgctatttttttctatgtagttgtttcagtaataccatatgagcagagaatactattgattcattcaattgaagaaatctgaataaattagtaaatataataattcttcaaaagaggaccactttatgtttccaatagattatataattgaattcaggtaacgtagagttattcagacttttttttttaaataacggaattttgcaaaaaaacaggttgcatcgttttctacagagaatattcagatgtgtagaggcaaagagactttcttgaaaggtttttatttcctgttaaatttgtgaggaaaactcctgagaaaggaaagatttacttttgaaggaagaaagaacataacccaaagaaatttgaaagattcaaaaagagttttccaaatgtattctcatttctttctcatatttgttcaaggtcttagtttccaagcattcaaaattaaatcttgtttgcctaactcttctaacatctattaccaacctaacatattacaattctgtttaaaatgtgcagttctaaatgttcttgcgtgcctcactgtggaaagtgtggtgcatggaactgcagcgtcagtatcacccagaagtataattacaagaagtgcagagtccttggccttaccctgtacctacagaagtccgcttttgggcaagatccccagatgattcatatgtgtattaatattgaaaaaattggaactagtaagtcctagaggaggtaaattttaagggctttttaagggaacttccaagtgtgaagacatttctggagatgacaagtcaacatagcatgggatcttggctagacaaggaaagcgagagaacattaaataaacacaagcaacgacaaaccacctatgttataattttatcctggaccatccaaagtttactcttggtcacgctgtctaacccagcctgcctcctggcacttgctagttagaaccagggaagagaaaactaatatgtgttaggtattataatttccttatgtcacataaattttggtgccatagctagcaatgtttcttaatatcacatcagtacaatgtgtccattgccttctgtaacatttttaatgctatcaataatacattgacattataaaaataaatgaatgtggtcaa

SEQ ID NO: 9216 - DNA, 4300 bp, Homo sapiens
  ENST00000637305
aaccatgggtagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcactacttgcttggccaccgtaggagactagcattgccactgtttgttaagaatatcactaacctcaaacatgttcattgatctttcagaaagctgagggaaaattaatatttgtcttcatgtgttatcggacttttaccaagactcgatcaatgttagttgtaaataactttttcaacccaaataaaaatagctattctgtgttgtatgaaggtaaaagtcattgtttaagaatttagttttattgcttcacttcaaaacttagagttttaaattttacaaaacctgattgtgagaattattcaattgtaatgcaatggcttgaaacctacaatattattttaacctgcaatgttttatgcaaaattgtatgctcgaatctacaaattgcttgtattacaccaaaaatcgttacttttctttcttcttgccataatcaagcatctgaaaatagtccctgcatgcttctggggaaaaaaaaataggttcaaatcagtcattgtagagaaaggcttacagtatttctcgtttctagaaaagcataacaattcattaattgcctatcttataattcctataaggctgacttggatctctgacttaagtctagaagtgaggttttcacttttatttaatattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtaagaaagggattgttcagtctacctagaacctatgggaaagctgcaagaccatttacatatcagtacaaaactcctttattttattaaaatatgagaattaacttcaatttattaagattacgtattggtcctttaaattattaaaggtttacatttgataggattaatggatttggtagtgaaatatttttatatatataaatttttggttttttattttgagcactattgggaaacataagcaaaattgaaatgcatggtctttcagtgcaaccatacaatttttattcactttgtaatagaatggacaaaaaaactaaggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtga

SEQ ID NO: 9217 - DNA, 169 bp, Homo sapiens
  ENST00000637256
ggtttacaaaaattctcagtctcttgcgtttattacgactttcaaggttaattagatacatacatcaatgggaagagacagtggaaccacagatggaaggaacttgagtcctggaatttctacttggagaagagacagttgtccatgaggtacatccgttggactttaa

SEQ ID NO: 9218 - DNA, 4738 bp, Homo sapiens
  ENST00000634658
aatgtcacgctgggcagaagtagagcaagagtaacgagcatgtgtggagagcggacggggagagaccctttctggccaacagagggcagccgaggggaggcgctggggcgcgagggctgagccgagctgagcctcgcctagctccggcagcctcagcttcagcaccagccgcaccggagcccggaccgcagccactaagggcagcggcggcggcgggagccaggcgcgcagctagcagcggcgcggtcgggaagcagcagccgccgccgccgccgccgccgccgcgacgggcagctgggctcgccggcagccggctcgggcccctaccctctcggctacgtgtctccggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagaggtaagatgcatctttttcttttttaaatctatatcatgaaattgttaattatggctgttttacaatgaacaactgtgcaatgtgtaatgagttttatgaaattcaagtagaaaaatgtattcgacgactcttttccatgcataagtgatatatttgtatccctaaaatatatgatcaaataatggatttgaatgaactgaaaaaaatagtgatcgttttatgccaatttattttatttttaaataaatgcactttaatcagcaattattatcttgatcaatacaacccctttcccaccttggttttttttaatctaatataaatacatcaagtaccattattttgataaagatgtgtagggtctgattgctaatctggcacatcattagctctgtgagatagtgtggtttttgtatcctctaatattgaagtttcattgaattcatgattgggtaaaacagattgtttctttatttccaaattgtatatataaaggctttgattttagcatattaattttgcttattgttatgccttgcctatagtaacttattttagtttctccctattagttcatttcataatactaaaaaggaacatattcatgagggacattagtacatagaaaacacaaagagtatagtgaataaatggagtgaatctgaccaatcaggcccatattttgctgaatagagcatctgttgttaggcagtgggtgggacctgagagggctcagccaactggagtttccaaagatctgagttaaaccatcatcaagcaaaggagttcatatccctatcttcaaagtctgaatattaaccattttgacttccttttcttcctaagtctttttgtattaattataacctgaattttatagtctgcataagcgtaagagtccaaaagacttgtagaatgcctaaatcgacactaatgaaagtcatataaagtcatatactggctatagaatattgctttcctccctacagaaatactttttagcattttcaagataaattatgtttttaaatatgtcataaaatggaagttctgtttgatttctgtgaggcggtagcagtgtttttgtatgtgcttgtcagtgacattttggttcacaggatttcaggaaatgacatgcaataataaaacactgcataatacactgataaaaaggcataaaaatggatcattcttaaaatatagatatgggatatatttaaaatcaaatgaagcacatttgagaaatcagattcatcttgtaatttttctctatatagcacattccatctaaaatggaataaatgttcagttctcaaagcctttttatgctaatttgagattaataccaaaccaagatgattcttgctaataattgctaatatttattgaaggcttattacacgtcagctagtatgtttgattctttacatatattagctcactgaatcttcctaacaacacaaagatgtaaatataattattgtcattattttacagatgagaacaattaaatacaataaggtaactcgtccagattcatagaactagtaagaagtggagctgggattccaaacttggcaatcagactcaggagccagtgctcttaactgcaaaactatataggttcttactatgatatataatgttttagttataaatatcttaatattctaccattttatagattgtctaacgaattatagggaacttttcttaagtaagactgtgggccatgcaatacaacagagttgaatagtacctcttaaaacaaggccatggaaaaatattttaacaaatatcctgtgagaggaaagtcactgatataaacatccagtcaattaaaaatacagtagcaatgtgactatttttaatatcttgtggttttagcccagttaccctagagaatggcagcaggatgaacagatggcatcctatcagataaaatggcaggccatgtggtcatataagagtatactccttaccaccaatgtcctttggcttctggcagtaattacaggcacctagatctgtgtaacatgatgtgttttaaagatgccatgataaaatttaggaacatcagctcactgctatcattattgtaaaatgcaatttaatatgcacttacagacatttggtaaccaagcacattcaggctagagttgtgggttggcaacatgtttcttataaataaatgaccttggtaataaatgaaccataagcccatttaggtgaagaatgttttcttgattatatgatacccccatataatatcatatatcatgggtatttaatgcccattagtaatgctgttcaacagggaagaaacagagtcataatccagaatttaatacaaattaatctttccatcacctacatgtttctaaccataatctccaagaaacttgaatggttccaaaactggaaatctctctacctgatttttctaaatgtcaccaggatgtgtttacaagtaaaaatacaacaaataaatcagaaaaagtagctctgtgagcttttgcaataaaaattcagaggaagatgtgagttcacccacatgtctttggttctgggtgttttagtatcaagctggctaatgctaaattcagcaaatttggggaagtaatgtgtgaagtctggaagctgccactgttctaaatgaatcattcctgaggaaagctgctgccttctataggaagctgcttccatcttcaacaatacatttttttttttctggactgaattagttcaactgaaaaacaacaagaagccctgatgccagataaattagaaaaatattatgaatgagatacagaagctttaaatttttgtgcttatgttattatcattactaaagctgaattagtggttaatacaggaggaaaaaactgatttgagcaactaatttatgaaacacatggtgttaagaagtgaggagggaagttgttttcatgaaccaattataagatcaatagatttgggatgtaaaaatagctttctgtgacattacactgaaactttatatatattgccaggtgaggtaaaaaccagagacaatttagataaatcaagccagaaatttcttttcttgtaatagctagaaagctgaggtgaatctttccaatttttatgtttggttttaaaaaactattatttgaattcagcattgtcgttgttgttattgtgtttaaagacagtgatccaagccagactgctatttcataacctatcacaagggtaacaaattccttgtgatcttcctaaaagagacatacggtgaggaaatccctggaaattaaatggaatatgtgacaatcacaagccactgaagagataaagagtagattaagggcttagtgaataggagattattcagtttgtaaaggtgaagagttcctttacagctgctgatctcagtcattttatcaacaggagatgaccttcgaaattttttagaggtttaggaaatattaattgcaaatacaaa

SEQ ID NO: 9219 - DNA, 124 bp, Homo sapiens
  ENST00000638054
gcaggaaagggttaaaactgcaggcttctggattatccacccttacagtgatttcaggcgctggttatcctcgctgtgtttactcagaaacagcggccggcaggcaaaagaagggcaatttgca

SEQ ID NO: 9220 - DNA, 3408 bp, Homo sapiens
  ENST00000251287
ggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaa

SEQ ID NO: 9221 - DNA, 7228 bp, Homo sapiens
  ENST00000261917
caaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtgaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccatccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccacaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggcagagtggggactgatttgaggttcgagtccacgcctccttgaggcccaagtctgtgttccttccatcagaaaactgtgttgaggggggctgaggtagatggtccccaagcatggtacagaaggaagacaccagattttggcagcagtcaggcctgggtttgaatcccagccctgccacttcttagctgtatgatcttgggcaagttatctgacctttctgtcacctcatttgtaaaatgggaataattatggtactgcctcacaaggacctatgaggaccagatgagaaaaatctatatgtgaaatgcccagcccagcgcctggcacataccatggtaggtgctcaataaaaaatcacatttcttctgcccctcatatgcccagcctattgctccagcaaactatgtgagagcccagggagctttggctgagggctccaagacttaaaatctcaggactcaggaggtggctgggcctccctaagggcccaaggaaggtgtgtggccagaggtgggtgggagccaggccttgagaagtgggaagacttcaacagggagagagggagggaatggtgggtgggatggagtgtatggtggggagattcctgaggtggatgtggagtggtggatcagggctttgggaggggatccccaggctgaggggtcagagggacggccttgggtgatagggtaagggattgtctgggcttagtcctggcaactaggagccataagcaggttccagattgcgggaacgagaaagcagctcagatgcctttggaggcaccatcctccctcctcccagatgggatcttgccagagccaaggtcaggggtctgcccctgcctatagggccagagcaggtatggctgcaatccccaagtaatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagca

SEQ ID NO: 9222 - DNA, 434 bp, Homo sapiens
  ENST00000373583
gcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 9223 - DNA, 2014 bp, Homo sapiens
  ENST00000373573
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 9224 - DNA, 329 bp, Homo sapiens
  ENST00000470998
agatcacctcaagagatctggattccagagatctgagtcttgctgatggctcttgatggaactgaggagtttggattcctcaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagccatttactgagcacctactatgagtgaggcactgtgcaagactt

SEQ ID NO: 9225 - DNA, 1037 bp, Homo sapiens
  ENST00000373568
gtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcat

SEQ ID NO: 9226 - DNA, 908 bp, Homo sapiens
  ENST00000436675
ccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatgtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccaga

SEQ ID NO: 9227 - DNA, 913 bp, Homo sapiens
  ENST00000415409
ggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaa

SEQ ID NO: 9228 - DNA, 679 bp, Homo sapiens
  ENST00000412342
aagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgac

SEQ ID NO: 9229 - DNA, 2133 bp, Homo sapiens
  ENST00000373571
agaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagagccctctttatcagaactccttgaggactcattttccctacctggctataatcaaaacaactactccagaaacacctgcctgcctttatcctttcctctctcctaaataccaaacactcataaatgttatatgtatatgcttttcttgtgtgtcactctgtattacccgatcaattctaccatataaatttctcccaaatctatctcttcctccttatccttgctgtcactggcctggatggttgcaaaagccctcatcaaccttcagggtatcctacaatagagcttgagtatctttaaaatggaaatctaattatgccttcaaagcacacacacacagatgcacacatgcacccacacaatgtttgagacattttgtaccctttaagcaaaagtccaaactcattagcctgccgggcatatatagcccacgtttacctctctagcctcatcccaccactcccgctgtcaagccttcatgtttctgcatgcatacttccttctccggacttagtcccctaccagtaaccccacaatcatctctgcctccaacttccctatcgtcaccctacatacctataaatttctatacttttaaaaaaacttttattgcacaataatcacagattcacagaaggttgcaaaaaaatgtacagggaagtcccatgtacccttcttccagcctcccccaatgttgacatcttatacaattatattacggcatcaaaatgaagaagttgatattggacattggtacaagccatagagcttatttagatttcaccagctatatatgcacgtgtgtgtgtgtgtgtgtgtgtgtgtgtgtgtgtagctctatgcaattttatcacacatgtagccttgcataactacaaccacaatcaagatacagatcagtaccatcaccacaaggttccctcatgctacgcctttatagctacatccatccctaacccctggcaaccaactaatctattctccacctctgtaattattattttgcaaatgtaatatgaatgggctcatgcagcagataatcttttgagattggccttcttgacccagcacaattcccttgagagccacccagattttttgcatgtatcaatagtttgctcctttttattaatgagcaatattccagtggcatggttgtaccagtttgtttaaccatttatctgttgaaatacatctgggttgtttccaatgtttggctattacaaattgagctgctacgaacattcatgtacaagttcctacacaaaaataagtcttaaattatctgaaatacattgcccaagagtacaatt

SEQ ID NO: 9230 - DNA, 2338 bp, Homo sapiens
  ENST00000439122
ataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgtta

SEQ ID NO: 9231 - DNA, 819 bp, Homo sapiens
  ENST00000373560
ccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagt

SEQ ID NO: 9232 - DNA, 632 bp, Homo sapiens
  ENST00000373559
ccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctg

SEQ ID NO: 9233 - DNA, 563 bp, Homo sapiens
  ENST00000478743
agaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggattttt

SEQ ID NO: 9234 - DNA, 592 bp, Homo sapiens
  ENST00000421523
ccatgggctttgggggtgggggtgggggcggtggacgaaagagcgttaggaagcggagaggacactgggctgggggaaatcttcagaaatttcgagtagctgtatcagatacctaaagctgtatcagaaggaagtgttctcatatcgtttctgagagcgcagcatgtctcttcgggacgtccaatggacaggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcg

SEQ ID NO: 9235 - DNA, 704 bp, Homo sapiens
  ENST00000373556
tccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaacta

SEQ ID NO: 9236 - DNA, 833 bp, Homo sapiens
  ENST00000373554
gcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtaagaaaatgacctttctgttttctgactctttccttgagtcagtttctcagttatgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaa

SEQ ID NO: 9237 - DNA, 607 bp, Homo sapiens
  ENST00000444609
atggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagttaagcctaaagtggcctccatggaggagatggccaccttccacactgatgcttatctgcagcatctccagaaggtcagccaagagggcgatgatgatcatccggactccatagaatatgggcta

SEQ ID NO: 9238 - DNA, 330 bp, Homo sapiens
  ENST00000486704
gagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggtaagttgtctttcttgaacatagccctgaagctaggtgttcgtagccttaatatcctgcttcacagtggggcaaggaaaagaatggtcttttgaaaaaattattttagct

SEQ ID NO: 9239 - DNA, 1740 bp, Homo sapiens
  ENST00000373589
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaacct

SEQ ID NO: 9240 - DNA, 2212 bp, Homo sapiens
  ENST00000300605
ttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagcactgt

SEQ ID NO: 9241 - DNA, 2224 bp, Homo sapiens
  ENST00000588183
aacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagc

SEQ ID NO: 9242 - DNA, 3229 bp, Homo sapiens
  ENST00000588861
gtcctaaccagaatttgtttagcatgtgaaacagtcatctagaaaaaaaataggatctttctttgccttcatatatcatcaacatagcatcctgttttctccctccattcatcatttatccatccatgaaagcacaggctgctgcagtgagtgaatcagccatgagcaatgcaggcagctccattcactcaacgaacgttattgagcccctgctgtgtgctaggtgctagaactaaaacatatacctaagccacttttgtcaatttctattttgtagaaaccccacttgcagagccagactaagcaaaagcctttaactccatggctaggaagcttatttatttgtctcttagaccactggatccagaaagtaggtcatatagtaatatttagtcattaacttacctgtaagatcaaatagaaaccttgtgaaggagtttatactaacgatatttaagcttgggaagaaaactggcagtagagcttgctgcggggaccatgctatggacaggtgccttcagggtgctaacgagagtgaggtatatattaattacctttgtacatttgatgctggctcccttcctgtaagaagttataatcagtaagataagacaggaagcgtcttctccaccatgatgcaaagatgtggaaaagagggtttttcaggctttgtgtttgtctggcaaagcctcttaaagtagttgtagaaaacagtaggtctcttgttgaaagagctgagtttaggcagagaaaactgggaaaagcagaagaatcaacaatagagaccacaaagggatgagagagcaaggagaaaggtgaagggcagaggcagccctggtggctacagggcaggagctgcgttctgcatttcctccctcccctctcttcttccctccattcattctttaaaaagatatttataggatagttactatgtgctagtcactatgttaggtacttggaatacattgggacatgtaacagatatagcccctgtctcaaataacttagtcttcttaaatgtgagacagatgttaaacaaataaatgcataattacaaattgttgtaaatgttgtggaggcaaagaacaaggtgaataacagggagggggtttaatttggatgggaaggtggggtctgacctgaagcatgaaggaggtagtcaggtgagaataatggaatgacaagggaatggcacgtgtgtaggccctcagaaaagcaggtccagtctgggactgcagcctggtgagccagtagcacatgcttaggtgagagggtcactggggctgcatgacaaagggcttggtaagcagcagtagagattttggattctttctgaagggcactgggacccattaaagggtctttaaatagggactgtgcaccttctgacttgtaaaagctctttgtgaccactgtggaatggttcctctgctgtgttgaggtgttaaattgtgtgccaggtgctagaacagcaggccatcttgaattccacggttgggagagtcaggcagtgagcctgctgcttgatgccaagtggcctgtcctgcctggcccctggcctgcgagcatccatcactcttttcctccccaacccagggcgttctcatctgctgggctcccgggctgcctggatccctgcgtggcagcagcacatcctgttcccagttgcctttgggagcggatgagtcctctgccctctggggtctgggcttccattttaaagcattaatttaatcaccaatctatctttagagctgagggtaggggaaagaaaatgatttcatcagctgtgaacatgtgaagggaatcttagctgtcagacgatccagtacctgtggctgtccattgtgaatgaccagagggcctggggaaaggctgaatgtgacatttctttgaattgcctcatttacatcctgaagcctcaataaaaggtgatttgggagatgtgcagcccctgattctgtcttaactgtaagggtggtgctgtgatgacccaggtgctcatggggtatgattaatttagcattctggtggcagcctgtgtttactggctttactttcatttcagggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgat

SEQ ID NO: 9243 - DNA, 788 bp, Homo sapiens
  ENST00000587841
agcggggctgtctatcccggctgaggacccgcggccagtgcgggtggctggctttgccattagcgggggcctttcctgaggacggcgtacggagtgtgggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacaggga

SEQ ID NO: 9244 - DNA, 809 bp, Homo sapiens
  ENST00000590815
cggctgaggacccgcggccagtgcgggtggctggctttgccattagcgggggcctttcctgaggacggcgtacggagtgtggaacagaattctggagtaaagaagcaggttcccttttcgctagacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatg

SEQ ID NO: 9245 - DNA, 569 bp, Homo sapiens
  ENST00000591480
cttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggctta

SEQ ID NO: 9246 - DNA, 568 bp, Homo sapiens
  ENST00000586546
ggcgtccgtcgggcagcagcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggttactcctggatggagcacctctgatagcaat

SEQ ID NO: 9247 - DNA, 569 bp, Homo sapiens
  ENST00000590481
agcagcggggctgtctatcccggctgaggacccgcggccagtgcgggtggctggctttgccattagcgggggcctttcctgaggacggcgtacggagtgtggccctccacatacataacccaacctttctctgagcgggacacaattcacaattctttatagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggt

SEQ ID NO: 9248 - DNA, 546 bp, Homo sapiens
  ENST00000588940
ctttgcagtggccccgcgcgtgcgcatagctgggcgcgaggcgcgctgtgggtctctgcggggcggatcgtgaagctagtgtgtcagtcattcctcgaagcgtgctcttgggctgtattttggagctagcgtccctcctgggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccgg

SEQ ID NO: 9249 - DNA, 576 bp, Homo sapiens
  ENST00000591268
agtggccccgcgcgtgcgcatagctgggcgcgaggcgcgctgtgggtctctgcggggcggatcgtgaagctagtgtgtcagtcattcctcgaagcgtgctcttgggctgtattttggagctagcgtccctcctgggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccg

SEQ ID NO: 9250 - DNA, 566 bp, Homo sapiens
  ENST00000587388
agcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccg

SEQ ID NO: 9251 - DNA, 559 bp, Homo sapiens
  ENST00000592591
cttccggcgtccgtcgggcagcagcggggctgtctatcccggctgaggacccgcggccagtgcgggtggctggctttgccattagcgggggcctttcctgaggacggcgtacggagtgtggacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattc

SEQ ID NO: 9252 - DNA, 557 bp, Homo sapiens
  ENST00000591671
aacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggtaggggaaatttggaaaatttaaagattggatatttatatgtacttacaaatcatttttaaaactggatgtttaga

SEQ ID NO: 9253 - DNA, 1173 bp, Homo sapiens
  ENST00000014930
ctcgccgcctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacagtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 9254 - DNA, 652 bp, Homo sapiens
  ENST00000540916
aatactgagctctgacattgggtgagataaaacactgccctggaggagagcttctttcaagatgaggcgtttatagataaagacgtattcacaggcttacaaagataatgtatagacttcacgtttctttcttttaggggctcaaagcactttatgagcatttcttaactcaccttcaagtgcgcgcaggaattcggagagcagtgggcccactgttattgtgctccatgtccagattggaagctgaggcacgaaccaatgaggcaaagtgtctgtgaacacaagcagagtcagccagagctaggctcccttcatacaccaggggattccgggatctcactatgttgtccaggctggaatgcagtggctattcacagatgtgatcatagcacagtgcagcctcaactcctggccttgatcagtcctcctgcctcagcctcccaagtagctgggaccacaggcatgcaccacaacactcagctacatggcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaa

SEQ ID NO: 9255 - DNA, 460 bp, Homo sapiens
  ENST00000535636
aagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatctgaaagtgccaaatgtggtgtctagcctggctccatggaatttttaacacggagttctcacacagcatatgatcattcctcaactcgccacttgatgtcactgcatagtcaaatgagcattcaaaattaccctgcagtggtttgtgttatttctgattctgttgaaagcaatgttaatgagatggtagaaggcaaatgtactacttcaaatgcaaaagtactctatcaaataatgcagtgagtgcattcaatgacaaaattaattctaaaatga

SEQ ID NO: 9256 - DNA, 2056 bp, Homo sapiens
  ENST00000536942
ctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgtaaggagacaatccttcaggcatccatgggtggcgcttgattcccgtaccactccttgcatcacctctggcaagcattcgcgtcaaatttttatggttgctgaattaatttaagtaggaaatgctgaatcctaacagtttctcattttaatttcttcaggctgcagcacacacacatttgcattttatcagaataaatgccttggccagttgccaaattgatgggacgagcttaagctttgcttaagcttacagtgaatgtctacattagccatagcagggttctaggagactcagcaaatatcttaagtcaagccatggtctggattcgtggacacatgggaagcataaagggctgaggaatacctgatttctaccccacactccctttgaatgccagagagcagggagcatttgctagagctgggcttccatcctccttgttgttcctggatggtagtcctttgagcagagcacacatctattctcttgtcatcctggtcctgtttccaggacttcatgtggggtcattttcccttgactgtagagaatagcaggtgcaaatggttactagtttctatcccttgtgctccaaactgccctcagaaaccaagtcttctagatcattgatgactcctcacatttgttaaaacactcccatgtgacaggcaccaaaccaggctcagggaaagaccaggatcttcaccagaagtaatcataggtggtttggctccgctcaggagcaacctcatgaaaaattcacatacatataatattgcactggactgagtattggtccacttcagggacctccaaacttggctgccctgctgcaaccctgaacctgatggtgggaccattttccccggagctgtgtcaatgttctgagaatgtgagtttcaccgctgtgtgtagtcctaggccaggtgactgcagggccctccagaggacagtgaatgtaatgcagctgggagctagcaccggagcctcagctcctgtgcttgtcctgcagtcctcattcagacttcccagcttcccttcagagggtgtggagaaagcaaattaacttaacaatatcttttcctagggtggagatgcaccttgggtgcagcatttaaggaagcactcactctcacagctgtccaagtgcaggatggggactgagagtgagcgcctccttaaatcttgtgccctgggttagatgtctgcttgtcttttccattctatttcctgtgtttgggaagcagcaggtataataaaatgaacttgtattttatttgaattccagctctactgcttactagcagaatgatgcttgggaagttagccactttaagacttagcttttgcatttgttaagtgctgataatataacctcctatatatgatgtgtgtgtgtgtgcatgtaatgtaaccttataggattattgttaaatatctttcagtatttactaagatactatttatgtattacctaatgtttatgacctgaagcaggttttggcaa

SEQ ID NO: 9257 - DNA, 5614 bp, Homo sapiens
  ENST00000367658
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgtgcctggccaagtttcagttctatatgaagtatttgatgttttgtttgaaacaatacagcattaaagaaccaatgttattcactaatatcattcatctttcagtttggatgatttggtttgctgcatctaggttggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 9258 - DNA, 9501 bp, Homo sapiens
  ENST00000395891
ggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtcatttgctatttttctaacgttgttatccatgttgcctgaaataggtcataaatgaaagtgtttttcttcactgggaaaaagaagagctcaagagaccccactatttaaatgtcatttaattgttttccatattaaaacaagggagaaatgtaagacgaagtgaatttcatatgaagccaatggctcattataccagtttgtgtctggacagtgtgttatttgtgttcctacactctaaagcattccggccaggagcggtggctcatgcctgtaatcccagcactttgggaggccgaggtggggagatcgcttgaggtcaggagttcaagacaagcctggccaacatggtgaaaccccatctctactaaaaatacaaaaattagccgggcgtgatggcacatgccggtagtcccagctacttgggaggctgaggaaggagaatcgctcaaacctgagaagcagaggttgcagtgagccaagactgtgccactgcactccagcctggatgatcaagggagacaccatctaaaaaaaaaataaataaaaataaaagcatttttttagtaggaattatctacaatgcccagcaccccttgcagcgatgtgtccgttgtcaatcaaggagtatacattatagaaatttagacttttattgtctaaaaagaatatttactgagacaggatggaatctgtaagttatatgatatagaatttgagggatatgtaaaattcagtacacgttcagcatctgaaaaataatggattccaatggagctattgttttatttatgaaatcagagcataaggactatgcaaatcattgaaccataaccttattctaactcttgcaacaacatctctaatataggggcatcttttatctttagaacttggtgttatatatatgtaaatactcattaattcaagcactctctttctagtactcacattatttgtcaggcattggaaaaggagaaagctgtttacaagatggaccagctcctggagagctttgcaatttatataaattactaattaatctattaattagattaattaatatctaatctacccatatacaaaaggaatgcagtatctcagaaattatatatagataggtaactttggcatacatgatttttcaactaccgtttccttatccaccagtactactgatgtcacagctatagatctatcccacaaagcataacaggaacattctttcacaaaagtgcaaaatttcatgaagaaatgctgatgtcacggtcacctgaaagaagatgaagcttgtaatattttattgcaaccttgcatagaatccttaaggaagaaaaacaaagagaagaggaacacagaaacaagttatggaaattcatgtttaccttatttataaggctgatttttaaattatatataatttttcattcaatatgtatatgaaatgaaatagctatagaactaaatttcacttaggtggaggtataaaccaccttaaattatatagttcggcagaaagacagatctatttgttaccacctgtaatttttttttaagcatgagttttctccatggaggcaaattgcaaaattaatcacttataaatttataagccacaatctccctaaaacaattgattttagtaagagtgtaacgcctttaatcaggggacaaacaagaacaataaataagagaagatttatgttacaactttgaaaaatgcttttaaaattctataaagtgttataataatttcatggatatcacaaatgttttattctacagtgtgaagatgataatcctaaaaatggaaattgattctgtgaggtcaggagaagtattctaaatctactgaactctttgtaatttcctatgtatataaatgagtggaggttgtgaagatgccgagagagtggtgaaaaaattaagaaaaagagacatatgatttgggggagcaggcgttaaacatgcaagatctaaattttcttttaatacatgaccatatgtccttgaacagtaagtatatttgtgtggcaagccaatggctgagttttccagggtagttttaatattacatccatcatattttcagtccatgtgtcaaaccatgtgtccaaaatttgggttcggaaatttctcagttgccacaaatattttcccagtcaagatgaaacactttcaaatgaaagtagttagaactttacataacaaatgtggtgctttattattattattattattatttttattattattattattacgtacttcagtgttcattattaaaactaccgcaatactatatcataaaaatctgggatggatgttccagccatcataaggtccaaaagaaaagagaaagtgttattttcctgttagtgacatgtagtccctttgttctagtaggaaaaaaggtgcctagaggtagtatatagagtaaatattgttcctttagcctacttcctgcagcttccaatttatccaaggaaatgtctacaacaattttgttcaaaagtctgttctagtcaatagcaggagaagtccacgttattgggctgattttgcttacatcagcaagagaaatgtcacgtgatactcaggccgcgctttctcttccatcacaccatcttcaaggaatgtcaataaactcactttggtatggca

SEQ ID NO: 9259 - DNA, 531 bp, Homo sapiens
  ENST00000490954
agtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtc

SEQ ID NO: 9260 - DNA, 5169 bp, Homo sapiens
  ENST00000453890
gcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaagactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaac

SEQ ID NO: 9261 - DNA, 2186 bp, Homo sapiens
  ENST00000492310
ggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggttccgggcacagcgcgcctcagtctgcattgggctgacaccagagagcatgtggggattttcctagttgccgaagaagatattatttgacgttgctgtagttttgtgcttacttctcttggaatctgcagtggtgcaattctccccttgttttccccccttctctttgaaaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacgaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccatagggtaaacctgtgactgagatcttactatcactaggttcccaccaacaggtcgtgcccaaaggtggcctgtaggctgcaatagtatagtctcacagagagtcaaaatggtatcattatatttcctttgtttttcctactaattatgttgcctgagccaacataagtgtttgttatattaaacaaacccatcccttttcacttgatgtgtaacactggttacttacccaagagagtaaaaaatcctattaaaaatattaaacagtattaaaagaagccctcaatggggcatttttctgtacaggtagaaactaaagtttgttttactatgaagaatattatttcattcatatgccagtctggtatgtaagatttaatcatatgtgacatttccataacaagatggaatactgggtaactactgtagagtttcttacttagaagacactagtatctgcagatgctagataacatggataagaatttgaaagcatgattctcatggaatgacagcaattaagatgctcacagaattcaattgtatatgagaatgggtttctgttttgtctcttttacattcatgtccactcatggttctcattaaagtggactatgaccagat

SEQ ID NO: 9262 - DNA, 497 bp, Homo sapiens
  ENST00000471527
acaccaacagaaaatcaggacatcattaattctctacacttattgatttggaacctccattgaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaagtagatcctggtcaagaatgtctccaaaactggattaagccagtgtacttgaatgggaatatagacaaccaggacagacttggaatgttttttaatgtattggcccagcaaagctagaaatcctccactttacctaacagaagataattagaattaaaaatggcactaactgaaa

SEQ ID NO: 9263 - DNA, 750 bp, Homo sapiens
  ENST00000493057
tcgccagtcattgcctgaactcggctttcctggaccttaggggataaatagtgtggtccagcactgccctgggtgagctgagtcatgcccttggcagggtcgaggagctcccgtgaggagaccaatcgcctagcgtgagtcttcttccgggattgctcgccctctgccccctaggtgccgggcgccgcccgtccccacctccatcagaactcgggtcatctgcggagccttggctgcggcccggtacctgggtgtgactccgccactaacattttcccagcaggaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaagtagatcctggtcaagaatgtctccaaaactggattaagccagtgtacttgaatgggaatatagacaaccaggacagacttggaatgttttttaatgtattggcccagcaaagctagaaatcctccactttacctaacagaagataattagaattaaaaatggcactaactgaaaacgtacttgttaaattgcctgtgcttataga

SEQ ID NO: 9264 - DNA, 574 bp, Homo sapiens
  ENST00000464944
catcagaactcgggtcatctgcggagccttggctgcggcccggtacctgggtgtgactccgccactaacattttcccagcaggaagcagcaagctcagcacagaaataaaactgtcctggtgagtcgctcacagcctgtcccagtaactgttccggagcgtcagcctgacgcagcacccctgaaggaccacgccgtgcgggctgcgagcctcgcccttaaccatgcccagcaggaccagagctgccagcacaaatgaaggtcctggccattgaacaacttctgagcctgcactttaagaaggcgctcttgttttgaatacgtagtctgtcctgttctttcaaaaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcc

SEQ ID NO: 9265 - DNA, 412 bp, Homo sapiens
  ENST00000481031
aattatcaagcagcccttggatcaaagggaagtctgatcctggggactttcttatgcctcccccagagctatggataatttccctgcctgcattcttcactgcaactctcttttatgagaaatggctgctctggcagaacacaaagatgactgcatttccaaggagatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgag

SEQ ID NO: 9266 - DNA, 2888 bp, Homo sapiens
  ENST00000471043
aatcaatagttgcccagtgaaatcactgtcttcgttgcctgtagctgatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccatagggtaaacctgtgactgagatcttactatcactaggttcccaccaacaggtcgtgcccaaaggtggcctgtaggctgcaatagtatagtctcacagagagtcaaaatggtatcattatatttcctttgtttttcctactaattatgttgcctgagccaacataagtgtttgttatattaaacaaacccatcccttttcacttgatgtgtaacactggttacttacccaagagagtaaaaaatcctattaaaaatattaaacagtattaaaagaagccctcaatggggcatttttctgtacaggtagaaactaaagtttgttttactatgaagaatattatttcattcatatgccagtctggtatgtaagatttaatcatatgtgacatttccataacaagatggaatactgggtaactactgtagagtttcttacttagaagacactagtatctgcagatgctagataacatggataagaatttgaaagcatgattctcatggaatgacagcaattaagatgctcacagaattcaattgtatatgagaatgggtttctgttttgtctcttttacattcatgtccactcatggttctcattaaagtggactatgaccagataacagccctatgtataatatgtatttctttaggtaacagggactacatttgaaaacactaaataaagctttctattgataaacatatacttatatacaatgtaacccttacaaagatagcaaaagaatgagaaaaaaatatgcagaatttccaagtgtcttaatttaaagttctttggattatcagaaggactttggaatcacggataattatcataaagacatttattattaattggaaccttatggtgtgtaggcagcagggtgcacagagacctgccactaactctccagccaaagggagctgagtttatggagctgcagtcacgtgtcacatgcagtgtttgcacttgccattcatggttgtgaggattaaacagacaaaaagtgtacataaagaacctagcacggccactggcacgtagtaggaacacaaaagaaaatggtattccttgtgatcttttttatttcatttagtcctcataatgcttctgtgacagcattatcaccattcctgcacgaggaaacaaggcttcaaaaggatcaataattatgtaaacccaaggcttgtgggtggcagagatccggccggaattcagactcacacctgtgtctctccaaagtccgagggccatccccacacaacaggcttctctcagggttcctaggactgattctgtagtttattgtgggccatgcttttcatttctctccttctctgccctactggctgctctcacagctgttagcacctctgccagggggtgggctggagaacaaaaacaggggctgtgtgggattctttctaccccagcacccagtgcactgccgcccagcatgcattagatagataccagttcgtacgtaaggaacagaacttctctctccagctcgctgcagccgcagagcccctctgccctcccatgctgagttctctcctaagtccaagctgccggctcctatcttcttagcactgtcccgccctccaagcctcccactgtggaaaggcacatccccagctgaaagcaagtacctgaggtggaaaagggtgtccccgaccaaaagaaggttagctatgattttcccagtgttcttgccacccagggaaatggagagcacagatcgagtgtgattgagcttacacctctccaagaggcaacaacagcaagccatggaggcgtttttcctcccaccctctttgatgggatgatagactgccccctggtggcggcgcagagcagctcctcctccaaagccttctgcttccacagcccctgggggccacttctgcagtgctgcctcctccggaggtgtcccaccgtggttaggagcagagtgttggggtgatggccatggaagcagtggccatgcagcctgagccatggcagaaccccagagtgcacccacaacaaaagtgaatccactttgcaccgcagcttccctctgccctcagcacatgctctccccataaagccccctgcatccgtggtttctgaaacgtttggctccacctgtactggctgcctccctgccctgagatatttgcacctttcccccctgggcacacatgcactctcatttccaatcctccttcgattccttggcctgtaaaatcccaggcttctgttggctgtctgcctgtaactctaaccatctcaccttcgcattgaagtgtcactggctgtcttgaaccattatttagtggtcctaccttatgcccccagctggacataagctatttaaaggcaggggcgatgtatgacatgctttgtatcaactgcagcacctttcacatggcaggggctcaaaaaatatttgttaagtgggtgaaaagc

SEQ ID NO: 9267 - DNA, 609 bp, Homo sapiens
  ENST00000461842
agtcttttttcgtggaccacaacagtcgagctaccactttcattgacccccgaatccctcttcagaacggtcgtcttcccaatcatctaactcaccgacagcacctccagaggctccgaagttacagcgctggagagggaccccagcttcctctgcaaatgggtgaccactaacgtgtgttccagctgtgtgattctcagagtctgtggggcttgattccacgtcttcaggaccgcataactaagagacccattaactacatagagctaagaggagcaggaaaggcaggacggaaggatggcaggtttgtctttaggcaagttgataatgtgtgtgaaaatagcagggtatctgattagatatgacagttaaacagatggaaatatgagactcagcaatcatcgatgggttatttccataatccattatttttctgtgtcccgtatcacaggcaatagggaattaactatagatatttcttagactacaacttacaagtgtgggtattttctgttcacctacataagccattctcttgagtgttattcagcagttgatttttttataaattgcatgtaaggacagaattaaaatgggtttctatattaa

SEQ ID NO: 9268 - DNA, 415 bp, Homo sapiens
  ENST00000429529
acccccgaatccctcttcagaacggtcgtcttcccaatcatctaactcaccgacagcacctccagaggctccgaagttacagcgctggagaggctagagtgcaatggtgcgatcttggctcactgcaacctcctcctcccaggttcaagcaattctcctgcctcagcctctcaagtagctgggattacaggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttgg

SEQ ID NO: 9269 - DNA, 9156 bp, Homo sapiens
  ENST00000311127
ccgctgcccgctgcccgctgccctcgccccgcgcgccgggcatgtgagcgcgggcgggcgccgtcaccatggcctcgccgcgcgcctcgcggtggccgccgccgctcctgctgctgttgctgccgctgctgctgctgccgccggcggcccccgggacgcgggacccgccgccttccccggctcgccgcgcgctgagcctggcgcccctcgcgggagcggggctggagctgcagctggagcgccgcccggagcgcgagccgccgcccacgccgccccgggagcgccgcgggcccgcgacccccggccccagctacagggcccctgagccaggcgccgcgacacagcggggaccctccggccgggcccccagaggcgggagcgcggatgctgcctggaaacattggccagaaagtaacactgaggcccatgtagaaaacatcaccttctatcagaatcaagaggacttttcaacagtgtcctccaaagagggcgtgatggttcagacctctgggaagagccatgctgcttcggatgctccagaaaacctcactctactcgctgaaacagcagatgctagaggaaggagcggctcttcaagtagaacaaacttcaccattttgcctgttgggtactcactggagatagcaacagctctgacttcccagagtggcaacttagcctcagaaagtcttcacctgccatccagcagttcagagttcgatgaaagaattgccgcttttcaaacaaagagtggaacagcctcggagatgggaacagagagggcgatggggctgtcagaagaatggactgtgcacagccaagaggccaccacttcggcttggagcccgtcctttcttcctgctttggagatgggagagctgaccacgccttctaggaagagaaattcctcaggaccagatctctcctggctgcatttctacaggacagcagcttcctctcctctcttagacctttcctcatcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaattgccacgacttcatcctcagtccttctttcaccctctgcagtggaatcgagaagaaacagtagagtaactgggaatccaggggatgaggaattcattgaaccatccacagaaaatgaatttggacttacgtctttgcgttggcaaaatgattccccaacctttggagaacatcagcttgccagcagctctgaggtgcaaaatggaagtcccatgtctcagactgagactgtgtctaggtcagtcgcacccatgagaggtggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgatcgctgggattagctacggtcaagtgcgtggcacagctattgaacaaaggacttccagcgaccacacagaccacacctacctgtcatctactttcaccaaaggagaacgggcgttactgtccattacagataacagttcatcctcagacattgtggagagctcaacttcttatattaaaatctcaaactcttcacattcagagtattcctccttttttcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttcttcttcagggcctcctttgcctctgccctctgtgtcacaatcccaccatttattttcatcaattttaccatcaaccagggcctctgtgcatctactaaagtctacctctgatgcatccacaccatggtcttcctcaccatcacctttaccagtatccttaacgacatctacatctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacagtgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccatgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaaaaaaaaaatgctgactacccttttgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaactaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggagtcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttca

SEQ ID NO: 9270 - DNA, 3973 bp, Homo sapiens
  ENST00000487661
gcctatagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgc

SEQ ID NO: 9271 - DNA, 544 bp, Homo sapiens
  ENST00000480667
aaataaacgtagtcaagaatgtaaatgaaccccatttttattccaaaaatagcaggctggccaggcacagtggctcatgccgataatccctgtaatcactttgggaggccaagatcgggggattgcttgaccctaggagttcaagaccagcctgggcaacatgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagt

SEQ ID NO: 9272 - DNA, 532 bp, Homo sapiens
  ENST00000482699
agaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgggagcctttttttgagatccaactggtcacttgaggattgctgttggcctcctggtttggggtcctaactccacctgcaactagatggtcgtaggaccttataaagcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagcc

SEQ ID NO: 9273 - DNA, 421 bp, Homo sapiens
  ENST00000488654
gctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccatgtgcaacaatactcagggatcctttatctgcaaatgcccggttgggtaccagttggaaaaagggatatgcaatttgggtaagagacttagtctatttcggactttattccgtaccacaatatattttacaaggtaacatttgttatttttcttgctaaccaaaatcagtatttgtccaaggtataaacttaaggaatatagaaaaaagtggaagctattgtccattattctaatacttggagatagaacaccctactttgcattatg

SEQ ID NO: 9274 - DNA, 1054 bp, Homo sapiens
  ENST00000477536
ggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgaccttggaagacagccgagagccaggccaagcactaggtgacagttccgccaatgcagaggacaggacttctggggtgccctctctcggcacccacaccttggctactgtcactggaaacggggaacgcacactgcggtctgtcaccctcaccaacaccagcatgagcacgacttctggggaagcaggcagccctgcagcggccatgcaccaagaaacagagggtgcctctctgcacgtaaacgtgacggacgacatgggcctggtctcacggtcactggccgcctccagtgcactcggagtcgctgggattagctacggtcaagtgcgtggcacagctattgaacaaaggacttccagcgaccacacagaccacacctacctgtcatctactttcaccaaaggagaacgggcgttactgtccattacagataacagttcatcctcagacattgtggagagctcaacttcttatattaaaatctcaaactcttcacattcagagtattcctccttttttcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttcttcttcagggcctcctttgcctctgccctctgtgtcacaatcccaccatttattttcatcaattttaccatcaaccagggcctctgtgcatctactaa

SEQ ID NO: 9275 - DNA, 946 bp, Homo sapiens
  ENST00000528971
gttaggtggagacagggtaggttgggacacaaagtccagttaagtgtgtgtcccagctcagtgctctgagcccagatcctcatctccctgggtagtgaggctcagcacagacaagcaaccaactgctgggctgccggtgccccccatgttggaacctgagttggagattatctcctaagcagatacctgcttccaaactggggatgtagggcttggaaactagaaaatgccaggtctgagggagaggaaagaacaagtccagcaatacacagagctctgtgtattcagagggaagttggcagggttgtgttcgggcagagaaactccgagtggtacaaaggggacgtgcccagagtggagaaatcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatggtaaagcgctctggcagggaaagaggcaagactggcaggtgggactagggaaaggtctgcccagcgcaccagctagactgagggaaaaccaacccaaaaggcacttgggagct

SEQ ID NO: 9276 - DNA, 595 bp, Homo sapiens
  ENST00000526273
gtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagtgagtttccccgcaggctttcctttagtactcaaagccccaagaggcaggtgaccatgagggactgaggacatcccaaagaaatgtcactggggggaggggaacagagatggg

SEQ ID NO: 9277 - DNA, 3602 bp, Homo sapiens
  ENST00000298251
gttaggtggagacagggtaggttgggacacaaagtccagttaagtgtgtgtcccagctcagtgctctgagcccagatcctcatctccctgggtagtgaggctcagcacagacaagcaaccaactgctgggctgccggtgccccccatgttggaacctgagttggagattatctcctaagcagatacctgcttccaaactggggatgtagggcttggaaactagaaaatgccaggtctgagggagaggaaagaacaagtccagcaatacacagagctctgtgtattcagagggaagttggcagggttgtgttcgggcagagaaactccgagtggtacaaaggggacgtgcccagagtggagaaatcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctgagccgcctcgggatcccctgagaggcgcccgcggtctgcggccagtggcccgggggaaagctggggctgggaagcccgggcgcggcgcgctggggacgaggggaggtcccgggggggcgctggtgtctcgggtgtgaacgtgtatgagcatgcgcagacggaggcgggtgcgcggaggcggcagtgttgatatggtgaaaccgggtcgcatttgcttccggtttactggctgtgtcctcacttggtataggttgtgccctcttaggaccacatagattattacatttctggcccaatacccaaaagggttttatggaaactaacatcagtaacctaacccccgtgactatcctgtgctcttcctagggagctgtgttgtttcccacccaccacccttccctctgaacaaatgcctgagtgctggggcactttttttttttttttttttttttttttttttgcaagttcagattagagaggccactttcccagaatccacagctgcactaagctaaggagaagccagatgccggttactgggtgtgcaggggctgttctgagctggggggatcattgtgaaggccttcttccctgggcacctggtacctggggacctacaaggtggtgagggaagggtacgagtacattccttttccctctgacctgggcgctagcaagggcaaagaacccgagcctgccagcttggcctcctcccacagcctccctcggaggcatgccatgccaagcactctttctgtctctgttcatgaataaaagagatggatgggcttattcttatagagaagtgaatttcacttactcccctggcccgaaaactagaccaaatgaggaactgttttagctcatcaaactcatatattcctcctggcttccttacaaaacaagcctttcaaacaatcattgtcctcaggaaagttgttgagcttcctccagctgtgagaataagtcctaatctccagagaaatggtggggggaggaggaggcttattgcttcccagcatttggggggaacatgatccaacccctggcctcctgccacccatctgccctgctcccacatgctcaggtcccagggcacagaaaaagggcagactccctaatcacactaacatcaaaataaagaggctgggccgctgtgtagccaggacatgcccatgccaccgcctattgaacagttcataggagtggcagtaatctactgtgtgaggagagagggcaattaaaaagctgaaagagaaggaggccctctgtgtattccattccctcctccttaatgcctccaagggtccttgcatccctagtctcctaaactccagctctgattcgccatcaacccatggagcaattccaaggccccagttacccatcacctccacaccaggtcaagttttgtctcagccccaaaggcactgacatttctagtttgccccctctgccctgaaccccacagcatgcctgtctcagctccctgtccctcggcacttccccaggctcatttgagcaggtgtgccttcgcagctcccctaaacttcccaggtgcctcatccataatgagataatgcatgtaggggaaaagtttctcaagaaggtggaagaggcagcaggacttggataaggagtacctgctggtcagccttgagatgcacaggtgaaggttagggtgagatgagaacatgccataccctggtgctgaatccctgaggggccagcttgccaggcttaagccaaatctgccttaaattgggggtggggaggggtaagtaaggaagtggggtttgtttttgtgttgttttcatcttcatctttgtattactagcatccagcagagtgcctagcacatactggatgctcaataaacttttgatgaaatgaaatgacaactttattccacataaacaagggtaacaaaacaagctgcttaaata

SEQ ID NO: 9278 - DNA, 2946 bp, Homo sapiens
  ENST00000439977
ctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcagagactcctgtcatcctagcagtttactctgcgtttgttgtatctagacagtcaacaactgagttgtcggtgtttaacctgaatgcttgtttttcagaagaggactgtttgtgccggtaagaatgatcaggtaaggccatgaaagtttttgttggcgtttttgtttttgagatggggtcttgctttgttccttgggccagagtacattggctactcacaagtgggctggtagctggctacagccccagactcctggcttaagccacctcctgcctcagccaccctggcagctgggactacaggcatgcgccatcacacttagcttgaaagttttaatttactaagaatatacctgtgtttccccccatttcctgatttaaacagtactggcttatataggaacccatcaaagttaaattccccaaatttaaatttagtaaatttagtggtttcaccttggcaaatctgcaatagtttcaccagctcaaatttcatgcttttgtaagctgagcttatgtttgtgattttaatcctttaagtactactgtggtaactaatcatttttttgttttttttggtggtgtttttgtttttgttttgagatggagtctcactctgttgcccaggctggagtgccgtggcgcgatctcggctcactgcaacctctacctcctgagttcaagcgattctcctgcctcagcctcccgaatagctgggattacaggtgcccaccacaatgtctggctaattttttgtatttttagtagagacgaggtttcacccatgttggccaggctggtctcaaacccctgacctcaggtgatctgcccgcctcggcctcccaaagtgctgggattacagatgtgagccaccgcacccagccagggactaatctttaaagcaaagttttatatatttttacgtgagtaatgttatgtgtaggtgttctatttggcaaaataaatcagccttttctatc

SEQ ID NO: 9279 - DNA, 570 bp, Homo sapiens
  ENST00000562914
gccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtacatcacttacacattaacttctgaatgtttttaagcactcaccaggttaggttcaggtccttaagtaccttcgtattacttttagcaggaaaaacggcatgttttgcatctggtgtgcaatgtgaagagtccttcaaaaatgccagaaatcaacgccaaggtgtgtctgcctcttcatgatggtaacaatttgtatcattcagactttcaggggagtaataaaagaagttggataaaac

SEQ ID NO: 9280 - DNA, 571 bp, Homo sapiens
  ENST00000568676
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtgtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagtt

SEQ ID NO: 9281 - DNA, 1125 bp, Homo sapiens
  ENST00000569569
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaaaaaaagaaaatgtaggcgttttatccttccattgtgctgaccgcttggttgccgtcatgataggaaattagtgctgctgcaggagaaaacagctgtcgtaagcattgtgcagctgctttgctgagtggctttgtgctttattgtaacaatgggtgacaacaagggagagactgtttaagaagtgtccttccaaagacttgggggtactaggaaaattggccaatttcttataactattaaagcttttctttagagcaaaagtcagaactaaatgctctgttatttggatttttatagctcttggaatacattgtttttggggaaaaattcattaactgcaagttgcaattctgtaactctccaattct

SEQ ID NO: 9282 - DNA, 798 bp, Homo sapiens
  ENST00000565966
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgt

SEQ ID NO: 9283 - DNA, 1388 bp, Homo sapiens
  ENST00000344114
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 9284 - DNA, 1862 bp, Homo sapiens
  ENST00000300302
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 9285 - DNA, 1425 bp, Homo sapiens
  ENST00000570273
gagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaat

SEQ ID NO: 9286 - DNA, 1782 bp, Homo sapiens
  ENST00000379792
gtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcaga

SEQ ID NO: 9287 - DNA, 562 bp, Homo sapiens
  ENST00000569429
ctgcccacgagcataattcttcatcacacaggagagggcatccgggcaggaaaagatagtgaagtcgtgagttccagcttgtggtagcgcctgtgtctgtttttgtttcatatggtcaagaatgttttagaacgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaacc

SEQ ID NO: 9288 - DNA, 567 bp, Homo sapiens
  ENST00000563343
cacacaggagagggcatccgggcaggaaaagatagtgaagtcgtgagttccagcttgtggtagcgcctgtgtctgtttttgtttcatatggtcaagaatgttttagaacgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaa

SEQ ID NO: 9289 - DNA, 511 bp, Homo sapiens
  ENST00000566550
gcctcccacagtgcttggattacaggcatgagccaccatgcccagccgataatttgccattctgtatttatttgcgtgttagagaccagttaaagttaagacactttctaaatagaagtcttgtatatggggcttttgagaaagtgttttcccgtgatgctggggggaaacacacatattcaaattacttgtataaaacagtttattctgtgtttaggaacttgtaggggtgaaatgctgacctgtgttactctttctttccatgatcagcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtgtgtctgcctcttcatgatggtaacaatttgtatcattcagactttcaggggagtaataaaagaagttggataaaacgtttattga

SEQ ID NO: 9290 - DNA, 774 bp, Homo sapiens
  ENST00000563781
aagtaccttcgtattacttttagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctg

SEQ ID NO: 9291 - DNA, 751 bp, Homo sapiens
  ENST00000568358
aggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatagaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgta

SEQ ID NO: 9292 - DNA, 2199 bp, Homo sapiens
  ENST00000564678
gctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgac

SEQ ID NO: 9293 - DNA, 844 bp, Homo sapiens
  ENST00000563911
ggggacagtatcctgaggattcctcaagtgatggtttaaggcaaagggaagttcttcggaacctttcttcccctggatgggaaaacatctcaagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaagg

SEQ ID NO: 9294 - DNA, 435 bp, Homo sapiens
  ENST00000567944
tcgatttgaattcttgattttaatttaaacttagttttcatttgttcatactcaacccactcaaaatgagtgttttttcaaatctatgtataggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatga

SEQ ID NO: 9295 - DNA, 458 bp, Homo sapiens
  ENST00000568651
ccagcaggcattccaaggcctgggtcctggtttctccggttacacaccctatgggtggcttcagctttcctggttccagcagatatatgcacgacagtactacatgcaatatatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtt

SEQ ID NO: 9296 - DNA, 509 bp, Homo sapiens
  ENST00000568814
gatgggtcttgcagtgagcttatcagggtgctgctgtgattagaggtggggagccttggattcttgagtaagtctcactgtgacatcagctaagatggacttttatgtgcttcctttgaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggat

SEQ ID NO: 9297 - DNA, 1578 bp, Homo sapiens
  ENST00000232424
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatcca

SEQ ID NO: 9298 - DNA, 1009 bp, Homo sapiens
  ENST00000476918
acacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatgtaagtggggaaatgctgctcgctcttttaattaaaaaacaaacactttctcagctactaagagtgaaaccccccgccctgcggggtctggcactcgctggtactgcgttctcccaggcgggagggcccggccttattcgctggggtccagagataatgcttgcgctccgtggccgggaggagggacccccagcactctgaagcagctgacacggggctcactttcctttcttgcctactctatgcagagctcgcggcattccaagctggagaaggcggacattctggaaatgacagtgaagcacctccggaacctgcagcgggcgcagatgacgggtgagggcggctcgccgcgtccccctgtgcgggcgtcccgctcgcctcgcggtgatttcttccagacttccgcccgtggttgtgagaggcattcagctacattttactgccttggctcactcttgcgttcccacggtctggggcttatttatagccacaactccaagttgttactgttccggaaagggagggaaagaggttgcagccgcgagggtggcgggcgccgggtaggggcg

SEQ ID NO: 9299 - DNA, 697 bp, Homo sapiens
  ENST00000377898
tgggcacggagcctgctgcccggggcagcctccccggcaacttccgaaagatttccaagccgctgatggagaaaaagcgccgggcacgcatcaatgtgtcactggagcagctcaagtcgctgctggagaaacactactcgcaccagatccggaagcgcaaattggagaaggccgacatcctggagttgagcgtgaagtacatgagaagccttcagaactccttgcaagggctctggcctgtgcccaggggagccgagcaaccgtcgggcttccgcagctgcctgcccggcgtgagccagctccttcggcgcggagatgaggtcggcagcggcctgcgctgccccctggtgcccgagagcgccgccggcagcaccatggacagcgccgggttgggccaggaggcgcccgcgctgttccgcccttgcacccctgccgtctgggctcctgctccggccgccggcggcccgcggtccccaccacccctgctcctcctccccgaaagtctccctggctcgtccgccagcgtccccccgccgcagccagcgtcgagtcgctgcgccgagagtcccgggctgggcctgcgcgtgtggcggccctggggaagccccggggatgacctgaactgaaggcgctccctatttggtctcgcgacacagggactattttcagcacgcccacagtgactgccaggaccccc

SEQ ID NO: 9300 - DNA, 2461 bp, Homo sapiens
  ENST00000368365
ggaaagttgtgacggtcgagcttgagcctggcgggccgcggagcgttcacctgcggccgggaggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 9301 - DNA, 2678 bp, Homo sapiens
  ENST00000368364
gggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 9302 - DNA, 5989 bp, Homo sapiens
  ENST00000222390
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtgcatgcactacagtttaaattatggtgtacctaatgtaacccctaaatattttagaagtatgtacctatagttttacctcaaaaaaaccagaaatctctaaagaccagtagaaatattaaaaaatgatgcaagatcaaaatgattagctaattctccatacataatctgcagatgatcttctttggttggcatttcaggtgtggccatcacccagagttaaataacacctaatctaggtgtttacatgtattcattatcctagttatttcatgtagtttctaattcttaaaggaaagagggtaatagttctatttgtgtaatttgtttcctccaaacttaaggccacttatttacacaagatatttgtagatctattttcctaaagcatttcttaagtgctcagatcagtatctaattgaagaagtttaaaagtgttttggtcattaaaaatgtacttaaataggttaaatctaagccttgctgctgtgattggcttctagctcactgcctttaaattttaaaaaatttaagaggaaaatttccaagtctccaaagttttataaatacccttcatcaagtcatgcattaaagtatatattggagaaaaaaataaaaatacttttctcaacctggaagattttagcctaataaagcttttttgaagtaaaagacaacttgtaaaaggaaagaaactagtttgtctcaactctgtattcatttattttttttttgaagtagagtggaatctgttgaatcagatattttatcaagatatgtttattttttcttatttcattttacaaagttcactcctaatgccatatgtaacagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaacttagatgaacaaggtccatgttattttaggtggtagaacagggtagagtcatgtcattatttgctggtggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaattaataagctgcctattgagtggtatagctgtatgcttacccaaaaaagggaacactgtggttatgacttgtattataaactttctgtagttaataaagttgttatttttataaccatgattatattattattattaataaaatattttatcaaaatgct

SEQ ID NO: 9303 - DNA, 2249 bp, Homo sapiens
  ENST00000457544
taggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatag

SEQ ID NO: 9304 - DNA, 1184 bp, Homo sapiens
  ENST00000444829
caggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacctagcttttctgaatttacaataaaaactattttttaacgtg

SEQ ID NO: 9305 - DNA, 1111 bp, Homo sapiens
  ENST00000453411
ggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacc

SEQ ID NO: 9306 - DNA, 1990 bp, Homo sapiens
  ENST00000423064
cacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcgagttatcagtttgaatttcaacactgcctgagacatccctctggggaaagtgaaagagagggtttacttacctactgtcttgagctcacatacctcaaaatctactactgtgtggcacctgaaaggagttgaatgaagcttagcctttcattagcaatgttaattctattcaaccagcacctgcttccacagaaattctgtccaaactatcatgaagtggtgtgacaagggtatatggacccagaagataatacaatataagaagggatcactggaagcttgaccccatgcacattttggtgaaaatgtgcctagaatcaaatgtgacacgtaggctggaactgagtaccattcagaataggatctgaagagatcaaagcaatggagaccaccaaactgtcttgaaggcatgtctatggaccttaagtccatgtctatgttttcagctcttctcacagcataaaagggcattgtccttacttttgcagtggaaaactgaatggctgacaagatggaagagtaaccatttcagcattgtatgtggtttcatttttcttagttatctggctactgaatagccggatttttcagttctgtcagaaactctaaatttccaaaaatctaagtgaaacatggatgaaactctgttagaaaattgttaggattttggagtatttggggagggggactactggaatgctgtccaagttttatactaagatatcttacctgtttgttattaaccaaatatttttaaaaatatttcctccataaatattcatttaatattaggttgatatttatcacataaaaagtaaaggctactgttagctaattgtcacagagaaggatttgttttctgttgttagtgaatttgaaatccttgactttatgtgctacagccagttccatctctgtttgtaaattcttactttccattccatatcatattctgttccctataacctcttcattgttttcttttcttttaaaaataataaacttttctatgatcacgttttgaaca

SEQ ID NO: 9307 - DNA, 842 bp, Homo sapiens
  ENST00000465234
gggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcg

SEQ ID NO: 9308 - DNA, 721 bp, Homo sapiens
  ENST00000453018
gaaatctagtatattgtcaagtaaaatcactttcttgtagatgatccttaggattttttttatatatgagccttaaaaacatttctccaatgtttatttttttaaaacattttgtatttaatagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacaggtaagaacagtatgaagaaaagagatgaagcctctgtcttttttacatgttaacagtctcatattagtccttcagaataattctacaatcctaaaataacttagccaacttgctgaattgtattacggcaaggtttatatgaattcatgactgatatttagcaaatgattaattaatatgttaataaaatgtagccaaaacaa

SEQ ID NO: 9309 - DNA, 590 bp, Homo sapiens
  ENST00000412881
attgggctcagccttgctcctcccttccttactcggataggagccactgggatctggagctccagcttccaaattgaagctggcctcaggccaggtgaccttttctttgattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctat

SEQ ID NO: 9310 - DNA, 545 bp, Homo sapiens
  ENST00000421558
attgagcgaattggtcccctgcctgtgccttgatttagccattgggctcagccttgctcctcccttccttactcggataggagccactgggatctggagctccagcttccaaattgaagctggcctcaggccaggtgaccttttctttgcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctct

SEQ ID NO: 9311 - DNA, 1425 bp, Homo sapiens
  ENST00000354224
atgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagtggtggtgatgactgccttgttgaatccactttttattctattccattttggggacacaattctgcaagatgattcttcattaggaaacagagatgagttattgaccaacacagaaagaaaaagagtttgttgctccacactgggattaaacctatgatcttggcctaattaacactagctagtaagtgtccaagctgatcatctctacaacatttcaataacagaaaacaacaattttcaaaattagttacttacaattatgtagaaatgcctctaaaacacagtattttccttatattacaaaaacaaaaattataattggttttgtcctcttttgagagtttgcatggtgttactccctgcatagtgaagaaaacattttatttaagtagatggatctaagtttttcatgaacaaaggaatgacatttgaaatcaatcctaccctagtccaggagaatgcattagattaacctagtagaggtcttatttcaccctgagttttctatgatcgtgattctctgctggaggagtaattgtgaaatagatctctctgggaactggcttcctagtccaatcagctcttttaccaatgaacacttccttgtgatatagatgtttatggccgagaggatccagtatattaataaaatccctttttgtattcaatgagggaaacacataattttcatcaattagcagcttattggaatatctgcatgatggtttaacacttttaagtgttgactaaagattaattttacagaaaatagaaaaagaaatatgtttctgtctggaggaatgatttattgttgacccctaaattgaaatattttactagtggcttaatggaaagatgatgaaagatgatgaaattaatgtagaagcttaactagaaaatcaggtgacctgatatctacatctgtatccttcattggccacc

SEQ ID NO: 9312 - DNA, 587 bp, Homo sapiens
  ENST00000490003
ctcccttctatgaggaatggagcacctgggccttgccatgttggtcaggccttgtcctctctctggacctgtttccccatgtttaacaaggagggagagctgacctggggctctccgagacccagacatagccccaagacctgactggccaggtgggtaaggctgctgacccaccatgtcctctttcctttggcctcttgtcccgctgcccatgctttcctggaccggataggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 9313 - DNA, 702 bp, Homo sapiens
  ENST00000466007
gaggaggagctgctacgtgaggtcaggaatgttgaatgcacccagggtgacagtgttgaggaggacgccctgttgtgtgtcctctcccatctcatccctgccctttcccacactcccagtggcccttctcccatctttcctgcagatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 9314 - DNA, 461 bp, Homo sapiens
  ENST00000426666
cgtcctctttggtgttgtcaacactgtggcatgcctcgaccacctggacccaccccagcctcccaagtgcatcaccgcactctacgtctttgcggaaacgcactttgaccgtggcatcaacgactggctttgcaaggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 9315 - DNA, 1750 bp, Homo sapiens
  ENST00000310417
agggcctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 9316 - DNA, 1865 bp, Homo sapiens
  ENST00000441594
agcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 9317 - DNA, 704 bp, Homo sapiens
  ENST00000480939
gaggacggagctgggtttgagcagggataggggaatctgtcaatcaagtgacatggctagtagcaattgcatatacaaatcaggagagactgggctaaagacacagatttaggggtcatcgtcatagagctagtacttgaaatcttgggtctggatgagatcatttgggaagtaaacgaacagagatagagaagctataatgtcccaggctgagcctgccacaatttgaagttggttggaggaggagctgctacgtgaggtcaggaatgttgaatgcacccagggtgacagtgttgaggaggacgccctgttgtgtgtcctctcccatctcatccctgccctttcccacactcccagtggcccttctcccatctttcctgcagatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggt

SEQ ID NO: 9318 - DNA, 996 bp, Homo sapiens
  ENST00000457462
aggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaag

SEQ ID NO: 9319 - DNA, 915 bp, Homo sapiens
  ENST00000416756
agctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcagg

SEQ ID NO: 9320 - DNA, 690 bp, Homo sapiens
  ENST00000455195
cacgcaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactcctt

SEQ ID NO: 9321 - DNA, 487 bp, Homo sapiens
  ENST00000417472
agttggaagccggaccccagagcctgaggtgggcagtgtgccagggtcccttgcggcctcctcaaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagagcgggtttgtaacaggcacttttgatcttcaagaggtgctgtttcatgggggcagcagct

SEQ ID NO: 9322 - DNA, 491 bp, Homo sapiens
  ENST00000442469
agttggaagccggaccccagagcctgaggtgggcagtgtgccagggtcccttgcggcctcctcaaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggta

SEQ ID NO: 9323 - DNA, 690 bp, Homo sapiens
  ENST00000497000
agggcctgaatacacagagcgctgagagagtggggcagtgtggtcacggacacaggcagggactgggatgtgacaggctggagctcagggacttgttgggggaatgggggtcagtgacaggctggaggcttaatgcgaggatggaggcttggctctaggggcagcacctggggtggtcatgggatctcagggaggggagtgggagtcagagaaagggtcttagagaagctggggctttgtgaggagctaagggagactcactgatcgaggtggggaccctgcaggcagaaacctgactgtagtgatagaggtggggtttctccgcacgcaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactc

SEQ ID NO: 9324 - DNA, 10072 bp, Homo sapiens
  ENST00000296575
tcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacggatgaaaaagcaagaaaacagccaatccttataaaattccagcattaaacatttgtaaagtgcttttcaccatagcaagactgtcagagtctatgttattagaatgttgcagatttccactgaatcgaacctcactggagaagagctcacttgtttttaaaaatcttggctatgtaagctgtcacctgtacaaatttttaacataataattcttgccaaatatgactttaaatgtacgtgttccttcagaactcaatgaaaatactctttggctaatgtatcaataaattttctgtaaatgttctgttcagggttttacagagatgacatgttctgacttaaaactgcaaaaagtctagtagatatttttcttcatggttttcaaagccagctctccacgtttggattttaacaaaatataaggcctctttgcactagtgaaaaaacacgtctactcatgacaagtgcacacccactatggctgtccttcttctgtaaacatccattcctctagaatctaaattgtagagcagtatagattatgcagcgccagctgactttctaaaccttctccttacctttaggaatacaagcctcaatttaaaaaatatattgtagctagtatttctctattgttttaaggtgagagatttgcaattaaagcccagtaagcatttatatagaagccacaatgtagaaagattggttaagtacactgctcttgtcttccatatatgattacttaagtttcaagtgacctcatgccaaatggaaatgggttgagaaatcttggttcagtgcttagtgaacaatagcctgcattaaaaagtgcatgcataattttgcacaatttagattcaattgacagtctattcaaagaagtctcaggattaaatgagcatggagaccaaattgccctcttaccccagaaaaggggtggtcccttctagtcacactaacacttcattggcccaacagtgtgacaaatcttgcaatgaaccatgcagtagcctgcatctgtaggttaatagcaatcttttgtctccattgctttctcttcatagcccttttactgaattccatcacagaaagttttacaattaaaaaaaaatgtcctgacaaccatttttgtaaatggaccttaccatctaattgtcccttattcaacgtgggtgacattaacaaaatgtgaacttcttgtgagggagccagctgtctaaatctgtcaaatcgtgcagttttattacacattctccaattcttcctagtttccctgaaaacaataaggatactgctatatattcagtaaaatctaaaaaaatcaagcattacttcttacatctttaaactttccatctcctccccaaaataaaaggtgttctattgccattagttctactgttttaaaatatctatattaagttgaccaggcccagattttttatacagctttttcccaagtgaaagattttcaagtgacttagaaaaacatatgtgccccaggtgtcattgccttttcttttgtgagtcattagaatgaaaggccaagttcttctcaagagaagatagcaagatccacggatattaagccaagcaaagaaagtaaaatcattggagtcatttctttctgttcttaggagaaaagtagatagcactggctaattgatggcaacatattttaaattaagtggtcaattcaaaaattctctttgaccttttctttcaagtagatttttttaaatgcatgactggagaattatcttcaatgattcatgatgagaggcaggtaggaattggttaagaagtatgagcaggaaaaaattattgtttaatcacatgaaaggcaacatctgttcagttcataaagcacacagtctcgaatggaagaaaaaaaggtccttcgtaagaatactgatgcataagataaagacgaaataatgaaaaagaaaaatgtatattattattcccttgtccattctcaagtttaagctgcggttgtcagttgaatgtgaaatgatgttatagttgttttaaatggttggaaataacctttctactactgtttctgccacactgttgtcctggttcatagaaccttgttttcttgacagttatttaaggtaataaaaggaacacaatttggcagatctttaagtgaaagagagaaaaaatttaagaaattgagtgatggctaaaagtaagtgcttccatccataacttttcttcttggatttttttcaatgtaattattgtaaaatatatttttttattttatcatgaagaatactcggaaggtttctcagattaatgagtatctcataaagagtagagaaaccaacacatacaatatatacacacaacctaaatagaaaactattttctttgtcatttgcatgccccagagaagttacttcttccctatttatttctttgaaaataattacaaaatagtatactaacaattttaatccatttgctgttttttttttttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaccatgcccagcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgttacctatactgtcagtgttcacctcctctccctccctccttctctctctctctccccctctcgctctctcggctaatatatatgtgtatgtgtatatatatatgtatgtatatatatacacacacacacacacatacatacatacatacatatattctttttccttttaaccacttccctctcctacattttctattggttttgcctaaatagacatgttctcaatacacccatgttgaaggtatcctgggctagattgctgttgattttgctggttatgatcttttctttgtttttctgaaaaatagcctctcttgattccacattttctcaaattctatataacaaataatagtggatagtaaacaaatgacatactaggctgatctattacaatcattgaaagaaataaggaagagcagaaatcactaacagtccagaggctccaattcagctgctctagcatagatacaggaaagacatggagaataacactggggttagctaacagcagggaaagttagtagctatttcctagccaaggaacaaccttctctatggaataattttaagaaaattattccaaatctgtgaggaaaaaataagaagcagttcctcaatggagactttataaatcttaatttcctcacccctgggatgagatttgaagttgcagaggactcagaccaaagtcccatggcagaaaatgtacatatttttaaactactcccaggaagtaaactagtactgtgaatgctggcaataccatcagaaagtttatctttaaaatacctaaaaataaatatatatttgctatcttatcctctttttgtcacacaaacataaattggtcatatatatatttatatatatggttatatatatttggttatatatatatctttatatatatatcttatatatatatctttttatatatatcttatatatatatctttttatatatatcttatatatatatctttatatatatcttatatatatatcttatacatataagatatatgtatatatatatacattatatatatataatatatatatattatatatatataatatatatcttatatatatatatatcttaatacatatatataaccatggaacctgccaaacactaatcctagccaacttcaatccttctttctcttaactatcttctctgaataagttctggacttcaccttaaaataagtttttaggagagtaatatatattcatgggattgtgagggagcattgtagagctgttttcttctcagtcatagtggtggttttcctagctgctatggaaaggtttgttcacttatgagattaggacttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactagggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttga

SEQ ID NO: 9325 - DNA, 1770 bp, Homo sapiens
  ENST00000434550
gaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaattttatttatttttgtgctggctacgttaattttattttagtgttaccttcctcactgaaggtatttctttgtaataaaagaaagaatcttgcaggagaaaataagggggcaacataagaaacaataattatggcacctgaattaggacagtgacattaaatttctgttatttgttgactattgtgcgctgcaatcgaattgatatttgacatgctttccccatgtaattgacacatttaaaggaatctttggctttataaagtattgtttaaatattgtttaatgggcataacacaggactgtacatcagcatttgctagtagaaacaaagaggtcttttggttattttggcaattgcaaatcattctttcaccatctctgtttttgagtctgtctcataaaaaatactacttatactac

SEQ ID NO: 9326 - DNA, 547 bp, Homo sapiens
  ENST00000505891
gattccgttgtgtgttcctctggggtaagcaagtagcatttcctcccccagagtccgcggtcgggatgctgtgcaaacttgcctatctctgaaaacagacgtttctgcggtacccgcaccctgggctggatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctg

SEQ ID NO: 9327 - DNA, 1298 bp, Homo sapiens
  ENST00000511314
aggacaaaaaggggtcgacttatcctcctccccactaaactgctgcccacacacagagtcctgttgcttatggcaaaagaataacaacaacaccattgtatttgttagttggttcactaatgggtgaaactagagaacatcattctctttcagtccccagctctgtccaaatgttcatgccttttgagggagcatttgtccaactccttctattcccagatgagtgagaactgtcttgctgcaggttttcagctgcaactctctttttattcttaccatatgcagcaggagcctgagattcagggaacagatattccaggattttattcaaagcaatgtctttaagctcctgtgttgcaactgaattaagtttcaaaatagctatattcaggtcaccttaaaggttttatcaggagccctaaagaaccaggaaattcagagaaaagtttagaaatatttgccattaagtctcccttggtgcaatacgtactatgaatatactgatgatctagagacccctgcaatactcaactcttccagagacatgtggaatgaaaattttgttcttgactaaatgatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccagcttcatctttctacaaatcaaaaacttgaagaggaaggtaccccgagggatgtattttgctaaaagaagccaaatgctggaagaattgggagagagaaatgattccagagacatcttcatttgttccctattgcccaatgcatgaagaaatgtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaatttt

SEQ ID NO: 9328 - DNA, 585 bp, Homo sapiens
  ENST00000515080
ttgaaaccaaagccagaatgatggctctatctatcttcaaataggtatttacactgcagacctcacacagagcaaaaatgttaccatcctgctgggccggaacagcatgaaactttaaaaagaataatattatacttgatttcagataatttattgaatcctacttctgaaatgtttgatgagagatctgtgaccagaacacattccaaaaattgtaaaagacaaaattccttaggcactaaaatcaagctcttcctggatagcagctgagagagtatatgaggatcattttgttttcagctataaaaaatggaagaatgcataatctccataaaaccaaagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaa

SEQ ID NO: 9329 - DNA, 563 bp, Homo sapiens
  ENST00000509630
tgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggaccttctcatccttttcatcatcaagaaaatcacgtggctgtcactatagacaacaaacaacta

SEQ ID NO: 9330 - DNA, 824 bp, Homo sapiens
  ENST00000512791
aaatgtaaaacacatactctgtcccccaatttctcagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatggcacagcatggattctagtcctggcgaggaagtatcattctctggatgaaggggagggcttttctcatactcaggaatttcctaactctccagcaaagtcctgtgacaaagcagtggcaagaaaaaccactctgtctcggcactagtgggtcctgtagaggctacttttccggtcacatcttgggatttggagaagatgaactaggtactgtacaatctagttctgttaagtttcattctcacttcctttttcaagaggctttgttctgccctgaagaataaatacagcaatcttatcctctacttgttggaaatgtaatccacagcaaagatgacctactccagagattaagatagtccagttacatattctctaccagtaacttttccctgagagc

SEQ ID NO: 9331 - DNA, 327 bp, Homo sapiens
  ENST00000503090
ggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacggatgaaaaa

SEQ ID NO: 9332 - DNA, 2101 bp, Homo sapiens
  ENST00000244302
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 9333 - DNA, 5852 bp, Homo sapiens
  ENST00000377670
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatgatgaattgcctggggtctgtaagaatgtgggactctgatcttccccctcttcaggtgtcagtgcggagaggctctgggccagacctcacccccagtgacttccgattgaggccaaagaccccaagctgcccgccagctctgactgccccttgcgctctgggcttcctgccgcccccagctttgcctggacactgacttcattcatggtcctcctacttcaggggcagcctcccagttcctctgcttccaaactatgcaacctccaacctgctccagttccagactgtataacctctgacctgcactggttctagaccacacaacctccaatgtggtctgctttagatcaccttcttcttcttccttcttcctcttcctcttcctcctgctcctcttcctcttcttcttcttttttttttttgacagagtcttgctctgtcacccaggctggagtgcagtggcgcgatttcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctctttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctaaacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 9334 - DNA, 507 bp, Homo sapiens
  ENST00000524533
gtcgttccgcccctctcagcgccccctcctggctgggtgggggcccctcttggctgagctcgggtgccccccctccccacccaaggccggccctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggtgagccccgcccgcgggaattcccgtcttggtcaggccccgcccacggaaaaaaactacatcccagggaggcccctcctccgggaagccttattctga

SEQ ID NO: 9335 - DNA, 2250 bp, Homo sapiens
  ENST00000244303
ctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcatt

SEQ ID NO: 9336 - DNA, 1486 bp, Homo sapiens
  ENST00000528563
cctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctcc

SEQ ID NO: 9337 - DNA, 573 bp, Homo sapiens
  ENST00000533145
acccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggccactaggatgtacccccacttccttgggggtgcatgggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtgg

SEQ ID NO: 9338 - DNA, 1709 bp, Homo sapiens
  ENST00000472815
actcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 9339 - DNA, 539 bp, Homo sapiens
  ENST00000526506
actcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagagtcccaattgttgggatggagctggggaggcctga

SEQ ID NO: 9340 - DNA, 2101 bp, Homo sapiens
  ENST00000291300
cgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 9341 - DNA, 2551 bp, Homo sapiens
  ENST00000300862
agataagtcagggaggggacagagcggccctaggcgcgccacagagaggagcgaggcgccagaggcaccatggactggcaagaccacaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 9342 - DNA, 576 bp, Homo sapiens
  ENST00000600879
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggcca

SEQ ID NO: 9343 - DNA, 2101 bp, Homo sapiens
  ENST00000600383
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 9344 - DNA, 767 bp, Homo sapiens
  ENST00000525854
aggccctgcttctaattccagtgcttcttggtcctgctttcttccttgggaatccaggccactaggatgtacccccacttccttgggggtgcatgggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaaggg

SEQ ID NO: 9345 - DNA, 549 bp, Homo sapiens
  ENST00000529205
cttgggaatccaggccactaggatgtacccccacttccttgggggtgcatgtaagtttctctgaatgaggaaaggcagagggaggctagcccagggtcagtccataattcagaccataactgactagagatgcccccatccccctgccccgggcaccaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgc

SEQ ID NO: 9346 - DNA, 544 bp, Homo sapiens
  ENST00000531043
actcagagcccccgctgcagtgcctggtgctcatctgcgaagccatcccccacccaggcagcctggagcccccactgggccgaggggccttcctcagccgccacagcctggacatgaagttcacctactgtgacgacaggaatggtgactctggattcagcctgcttgagtgtcagtcttggctgtgtatccttagccaaatgacttcacctctctgtgccacaatttcctcacctatactgtggaatcataacagaacctgccttgtacagtcgttctgagcagctcagattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcag

SEQ ID NO: 9347 - DNA, 313 bp, Homo sapiens
  ENST00000600236
gagccaaggaccctccctgactcccacctccctttctgccttgtaccccagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagcc

SEQ ID NO: 9348 - DNA, 1031 bp, Homo sapiens
  ENST00000529542
ccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcagatgaggaaactgaagctcagactgttgaccacaggcacagaactcagaagtgatggtgctgggacttcagccaaggtccacccaagtccaaggctcatcctcttacctccctcctgccctccgcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcga

SEQ ID NO: 9349 - DNA, 2004 bp, Homo sapiens
  ENST00000475432
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacacctgtatgtatcccatttccccaggtgcgaagccagctgccacatggcccccagctgacaccaggaccccccagctccccataccccaggatgcactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgtgtgtgtgtgtgcgtatgagcatgcatgtgtatcatgcataagtgtatgtgagggagtgtgcacgtgtacacatatgaggaatgtgtgtcaccatgtaaatgccggtgtgtgtgtctgcatggacacaggtatgtgtatgggtgtgtagactgttaatttttttttttttttttttttttttttttgcgtgaacctctgcttaagtggattgttaattcaaattagaaaggggtctttatttggcctggcatggtggctcatgcctgtaatcctagcactttgggaggctgaggtgggcggattgcctgagctcaggagttcgaaaccagcctgggcaacatgacgaaatgctgtttctactaataataccaaaaattagccgggtgtggtgacacatgcctgtaatcccaactactcgggaggctgaggcacgagaatcattagaacccaggtggtggaggctgcagtgagccgagattgcgtcagtgcactctggcctcggcaacagagcgagactctgtctcaaacaaacaaacaaacaaacaaacaaaaggactctatattcaagttaaaataagaagtgtaacagaatcatggggtcttttttgctttttaaattttgatgtggctcacacct

SEQ ID NO: 9350 - DNA, 562 bp, Homo sapiens
  ENST00000533789
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccat

SEQ ID NO: 9351 - DNA, 1373 bp, Homo sapiens
  ENST00000321331
ggctgggacggctgtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcaaa

SEQ ID NO: 9352 - DNA, 1322 bp, Homo sapiens
  ENST00000418900
gcgcctgcagggatcggaagccggttggggtgtgagaggttttctcgctctagaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatg

SEQ ID NO: 9353 - DNA, 983 bp, Homo sapiens
  ENST00000470543
gcgcctgcagggatcggaagccggttggggtgtgagaggttttctcgctctaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttg

SEQ ID NO: 9354 - DNA, 741 bp, Homo sapiens
  ENST00000430190
gtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttgcattctttttctttaggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatg

SEQ ID NO: 9355 - DNA, 585 bp, Homo sapiens
  ENST00000452906
aagcgaaacaagccgggggactgcgagccagggactcgggccgcggggcgggaagaagtggggcagcgcttggccaggccgaaaggactttgggggtgggggctgggagtccgtgtctcgaatgagggaggagaggtggagttgccggggctcaggcccggcctcgagcatgggcggatgagaggagtcgggagccgaggcctagggtccttcgggtgaggggagacggagccagcgaggagatggagcagaagcttgtggaggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttg

SEQ ID NO: 9356 - DNA, 8013 bp, Homo sapiens
  ENST00000336926
gcccctgactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggc

SEQ ID NO: 9357 - DNA, 7066 bp, Homo sapiens
  ENST00000434438
gactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagagggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctct

SEQ ID NO: 9358 - DNA, 728 bp, Homo sapiens
  ENST00000404944
atctccttgacagcctgtgcctttgggctggggagggggcaggaaagccaggtggctgctctgtcccctacatggggctgatgaagacacccagcacccctcaggtccttctccacccctaggttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaa

SEQ ID NO: 9359 - DNA, 583 bp, Homo sapiens
  ENST00000420909
gtaattggctctccggaaccagccggggacacgagggcctgctgggtcaggaagtggtggacaatgccaccctttcaggggagacacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaa

SEQ ID NO: 9360 - DNA, 419 bp, Homo sapiens
  ENST00000485723
gctcctcgcggcgacatggatcggatggccagctccatgaagcaggtgcccaacccactgcccaaggtgctgagccggcgcggggtcggcgctgggctggaggcggcggagcgcgagagcttcgagcggactcagcagctgcagaggagatactcggaggaggaggaaagagaagtcacggagccctgttcttaaccgagttttgcagtcacctccccgtattcctctctcactctgaagccgagcacagaacccagcctctggtggtaccgagtgaaggttggcctggttggttggatggatggccaaatgaactccagaccactggattgtataacaggacagcaagaggcagcacagagccgtggaaagaacctgtagccataacatttgatgaatgaatcagacatgtgacatta

SEQ ID NO: 9361 - DNA, 503 bp, Homo sapiens
  ENST00000479835
ccggggcagccgagggcccctgactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagggtcgctgttggtctagccttgcctcccgcatacccagtctagagcctggccacatgcccatcaaaagactctcactgctctgcctgccttcttctgtcctggcgtctataccctcagaccagccttgcatacctactcctgccagcctcctccaggaagccttgcctcctcaactctcctgcaccatcctcacatttcacctggccactgtcactgccagaggaggcaccactgacctgcctcatggcccagccactgcacccatctccaaccagacccttggtgtgttccccacccaatccatcacaagccactttcaagctttagggaagtgaaaagt

SEQ ID NO: 9362 - DNA, 3120 bp, Homo sapiens
  ENST00000616821
tcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggag

SEQ ID NO: 9363 - DNA, 3078 bp, Homo sapiens
  ENST00000535831
cggtgcctctcccttcaaaagcaagggacctttatgcatgattccacatctgcattccgataggaaagggaaacagcagaaacacaatacccatctgagagctacgcttagagaggactctgggcttttatttatttttttacttcagtcttgtgaccagtaattttaagggaaagccaataataatgtttttaaaaagcctcacgccacccctggcggcatctcctcggtgtactttgctgttcagatccgcctgccttctgtgccagcctaacagcgcccggcctcagcccccattgtccctggagctggcgaggtgtccggttgcggagccggcggcgtctctggaaatgcatcctgcatccccgcatggataacagctgcagctatgtcagaattgcacaaagaggggagagtgtcattgtgtgccttttgacacatacattaagaccaaaaaggaaaaaaagcgtctatctgtgctgccaccgaccagactcatggaggccagattttctccaattaaccagatcttgccctggtgcagacaagacttagccatcagcatcagcaaagccatcaacacccaggaggcccccgtgaaggagaagcacgcccggcgcatcattctgggcacacaccacgagaagggggctttcaccttctggtcctacgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggtatggcctccccagatgcagcagcaccactgagttcactgccgtctggcaaccatcgatctgtctccgtgatctgcctgttctagagatttcatgtaaaggggatcatacacgatgcatccttttgtgtccggcttcttcactcagcatcacgttgtcaagggtcaccacatcatagcctgtgtcattacctcattccttttatggctgagtcgtactctgccgtgtggacagaccacattgtgtttatctgttcatcacttggtggacattgggtttgttgcaactttctggctgttgtaaatagtgctgctgtgggcctttgagcacaagtttctgtgtaaacatctgccatcacttatcttggatagatagctgatgtgtgtggaacacagtagaactgctgggtctcacctctgttaccctgttgagaaactaccagactgttttccaaagtggctgcaccattttacactcccaccagcaacgcatgaatgttccagtttctccacatccttgccaatgcttattattgtcttctttttattttagccatcctagtgggtgtggagtggtttctcacggtcttgatttgtgtttccctgatagcaaagggtgctacatatcttttcatgagctacctggccatttgtgtatctttggagaaatgtcttttaggaccttgagctcacgttttaattgggttatctttttattcttgagctgtgcactgtgtgggaagcctctttctagaaatctccacccccctgaccagtgagggtctcagctgggctccaactgg

SEQ ID NO: 9364 - DNA, 4539 bp, Homo sapiens
  ENST00000253083
ctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctacgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtttgttgtc

SEQ ID NO: 9365 - DNA, 2054 bp, Homo sapiens
  ENST00000452196
tggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctacgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggtatggcctccccagatgcagcagcaccactgagttcactgccgtctggcaaccatcgatctgtctccgtgatctgcctgttctagagatttcatgtaaaggggatcatacacgatgcatccttttgtgtccggcttcttcactcagcatcacgttgtcaagggtcacc

SEQ ID NO: 9366 - DNA, 538 bp, Homo sapiens
  ENST00000536772
tggccgctgggtgggggttctctccacagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccgga

SEQ ID NO: 9367 - DNA, 1233 bp, Homo sapiens
  ENST00000536847
cgggccctgggggtgtcaggggcaggggagacgggccctgggggtgtcaggggcaggggagatgggccctgggggcaagcgaggtttcagggtcacttggggtgtgcagagccaagctgtgaccctagtgccgtgttacttggcagaagccctgcctgttcccacatctgtaaagttaggcatttggggtgctccatcgtgagcctccttcctgctctaacattcagcgtgggtttgaggcccgtgggcatggagctatccgtcacccttgtcagtcgggcacctcgtcctgggctcccaggtggaggtctctggaagcccttgctgagctgggctgggagctcctttgccctgaccttgttgttgccgttgacctccttcatgggagcatctggtcttgacctggggcagccaccagcacatgaggctcccgtcttggaggcagggggcacactggtgtgtgggagctggcttagggccctgcttcacagttggaccaccttggacaggttgcccagctcccaagggctcacgttcttcctcctgccccttttgcacagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggc

SEQ ID NO: 9368 - DNA, 711 bp, Homo sapiens
  ENST00000541712
cccacccgcacagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggtgaggggctgtgacccgggggggtctgcacctggagggccaccagtcattgctgtcttggtctcggcaggctatccggctcctggtgacgacatccactagcctgcagaaggagatcgtggagagcggcagggtgaggggccggcggcagcagggcacagtccacaaggagcctgacccccagcctaggccaccctgggcatgagaccctccaccccctaccacagggaggcctcagggatgcgccctatg

SEQ ID NO: 9369 - DNA, 1616 bp, Homo sapiens
  ENST00000536617
ccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggtgaggggctgtgacccgggggggtctgcacctggagggccaccagtcattgctgtcttggtctcggcaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaa

SEQ ID NO: 9370 - DNA, 1176 bp, Homo sapiens
  ENST00000538236
ctcccccaggatcctcaactcctgcacagacctgatgaaggtgaggggctgtgacccgggggggtctgcacctggagggccaccagtcattgctgtcttggtctcggcaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtgtaggttgccctgggtgggggggggcagggggctgcttcctgccagttggagcagtttggggttcaacagggtgcagggagtagagggggtgtggagtggtgccagccgtccgtggggtcagagaccctggccctgactggcccttgacccgcagggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtaggcgcccatggctgccccgtgacctctgagctcatccctcgggcgaagcctggacccaggagagagctccctggggaggctgggctgggctgagcaggccgtgtggctacaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccaggtgccgtctgcactgggatgggggagttcctggacgggggtgctgtccccagccctagaggggcacatggtgcacgtccctggggaagtcagggaccactgacaacatgcagggaggagcttgctcaagggag

SEQ ID NO: 9371 - DNA, 924 bp, Homo sapiens
  ENST00000535012
gacgacatccactagcctgcagaaggagatcgtggagagcggcaggggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagct

SEQ ID NO: 9372 - DNA, 665 bp, Homo sapiens
  ENST00000537322
aggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccgtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccat

SEQ ID NO: 9373 - DNA, 2452 bp, Homo sapiens
  ENST00000291823
agagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcaagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgagacctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagca

SEQ ID NO: 9374 - DNA, 496 bp, Homo sapiens
  ENST00000377777
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattc

SEQ ID NO: 9375 - DNA, 789 bp, Homo sapiens
  ENST00000289316
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaa

SEQ ID NO: 9376 - DNA, 752 bp, Homo sapiens
  ENST00000430394
ttttttcgcgcaaaaatgccggatccagcgaaatccgctcctgctcccaagaagggctccaaaaaggctgttaaaagagtgcagaagaaggacggcgagaagcgcaagcgcagccgcaaggagagctactccgtttacgtgtaggaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgtgagatccagacggccgtgcgcctgctgctgcccggcaagctggccaagcacgccgtgtccgagggcaccaaggcggtcaccaagtacaccagctcgaacattttctagctgaagttactgttgttgtcaactactcagcatccaaaattttcacaagaaaacaaggttttttctcttcaaattacagtccaaagagtggcaaacaagaaagatgacagagtccgaagaccttaagatttcttttctttggtcaagaactcattacacaatggatgatacatcttaggtggtcctactaaaaagagacacaagaatctagagactatctcactgtcaaccaatccaaggaactttgctttagatggccaaagccagaaacagcaaagtagaagaactactagagctttaagcagttccttagtatttttccttggcttatccaagcctggatactggtc

SEQ ID NO: 9377 - DNA, 381 bp, Homo sapiens
  ENST00000412169
atgccggatccagcgaaatccgctcctgctcccaagaagggctccaaaaaggctgttaaaagagtgcagaagaaggacggcgagaagcgcaagcgcagccgcaaggagagctactccgtttacgtgtaggaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgtgagatccagacggccgtgcgcctgctgctgcccggcaagctggccaagcacgccgtgtccgagggcaccaaggcggtcaccaagtacaccagctcgaagtaa

SEQ ID NO: 9378 - DNA, 2194 bp, Homo sapiens
  ENST00000369155
ctgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaaa

SEQ ID NO: 9379 - DNA, 459 bp, Homo sapiens
  ENST00000420462
gtaatgagttggccctcagtcatccccgtccagtcttactgagttgcttgttatctgtgctacgagattcgaaaggttaataggacccatcctttggaagtaggaaagtggcatagaaggagaagctgagttagagatcactcacccacttgcccatcaactggaactgcaagagatcagagaataaagatatcagttggtccaaggaaaataatgaggaagagagaattggggagacagaattaatgtagactctgagggatcaactcagatctcttgagtttctatttctctttctcaaaatccagtactaacagaactgaacaagctacaggtggttatcaaggaaacttcactgcggtgcgtccaggcttaatgctacctcagggttgcccttcccatccttttcataaaataagctctaataaaccatggaagcacagatacaagttgcttcat

SEQ ID NO: 9380 - DNA, 752 bp, Homo sapiens
  ENST00000469483
ttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaacattttctagctgaagttactgttgttgtcaactactcagcatccaaaattttcacaagaaaacaaggttttttctcttcaaattacagtccaaagagtggcaaacaagaaagatgacagagtccgaagaccttaagatttcttttctttggtcaagaactcattatacaatggatgatacatcttaggtggtcctactaaaaagagacacaagaatctagagactatctcactgtcaaccaatccaaggaactttgctttagatggccaaagccagaaacagcaaagtagaagaaccactagagctttaagcagttccttagtatttttccttggtttatccaagcctggatactggtc

SEQ ID NO: 9381 - DNA, 407 bp, Homo sapiens
  ENST00000620458
catcacatcccgcgagatccagacggccgtgcgcctgctgctgcccggcgagctggccaagcacgccgtgtccgagggcaccaaggcggtcaccaagtacaccagctcgaaggacagcacaacacagaatgaggatttgggtgaagttgcaaccaccgaggtccacataccagtttagaagcctcagagtataagtcattgggtatttaaggaccttacctaagctaactcagaagcattatgaagggcagtattgacattaactgccaggaatctcctaaaagtcaagggattatacatgagtcatagaaggatacttgaagatggacaattatagtcccatcactttatggaacactataagacccaaataagagaaatcccagtggtccacgaacttagctctg

SEQ ID NO: 9382 - DNA, 1954 bp, Homo sapiens
  ENST00000369167
cttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtccagtcttactgagttgcttgttatctgtgctacgagattcgaaaggtttgactcgttctgggatatttgggagggatggagggaaggaggcggggggtggttctacaccccttcggcctttaacctgtatctttaaagtcgttttcctttttgtttctgaaagtaatgaacgagatgagatttcccatacagatgagaaaccctcggtccgacctcttactatttcttagtgttttaatctgttttccttaccatatacctacaggcgtctgtcacaaactttgtctaatatagccatgtgctttcgtcccttagcctttttgcaagtcctgacttagccatcctcccctaacttccattccagtgacttcaaacagggagatatattgccaccaccccaccccctgtggagtatttggcaatatctgtagatgttttgggttgtcaggtgtgtgtgtgttgcgggggaggtgctagaagtatccaatgggcagaggccaggagtgctaagcataaggcacaggacagtcctctggggggacaaagagctacctggcctgtaatgtcgatctttggtgattgagagaccccagcgcccaaagacatccctaaccttcaggatttaatcctcttcagtcaaacgtttccttaaccctatcagcccatgtttttcttttcttggtgaaagctgagcacttcataggctgtttacaggtccttctccacaggaaaatacttcctccaggacaagaaccctgtcttggttccaaactttcccaattataagagtcacctttgcgcttgttaaacctgcttccaggtgcttctcctgaggtttcctgattcagctagactggaggtgggacctgacgaggtggttggtttttagtgttctcaggagtgtggatgttttaataggtgttgggtcctcatgttaatcgacctgtgggtgtgtcacagtctttgtgtcacagatgtcctgagaaaggaaacaatttgaggatgagtggaggggaatttgtggtgtagagaaggccacagttaatatgtggggtgaatttctgaagacctctcagttcaaaacttgaataactcaagactcatcctgacaaaagccagtggatgtttcttttgccaaataaaatatacccttggtgcaactggaaaatcttagcttataattaacttgacagcctttgaaattaagccattcttgataaatcttgggggaattaacaactttgtgcttaaaatgaattttactaatttttatgatgttgaaattcaaatttacacccaattaaaagatataaaatgcggta

SEQ ID NO: 9383 - DNA, 999 bp, Homo sapiens
  ENST00000545683
ggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagttaataggacccatcctttggaagtaggaaagtggcatagaaggagaagctgagttagagatcactcacccacttgcccatcaactggaactgcaagagatcagagaataaagatatcagttggtccaaggaaaataatgaggaagagagaattggggagacagaattaatgtagactctgagggatcaactcagatctcttgagtttctatttctctttctcaaaatccagtactaacagaactgaacaagctacaggtggttatcaaggaaacttcactgcggtgcgtccaggcttaatgctacctcagggttgcccttcccatccttttcataaaataagctctaataaaccatggaagcacagatacaagttgcttcatactcatgagttctacccagagttaccacaggaagacaaaactcttgactcacaacagccacagcctgtacccttctaactgtcccctctgagtccaacttaccccaaaggagcagagttgtcaagaaccacatgttgtctccaagctggtgggagcagtgaaatctgtaacatgcaagatattgaaga

SEQ ID NO: 9384 - DNA, 5772 bp, Homo sapiens
  ENST00000290573
cggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 9385 - DNA, 5278 bp, Homo sapiens
  ENST00000409174
acccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 9386 - DNA, 395 bp, Homo sapiens
  ENST00000472302
ccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgcc

SEQ ID NO: 9387 - DNA, 948 bp, Homo sapiens
  ENST00000509042
cggtgacgcgggtggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactg

SEQ ID NO: 9388 - DNA, 2515 bp, Homo sapiens
  ENST00000383463
tggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaa

SEQ ID NO: 9389 - DNA, 1490 bp, Homo sapiens
  ENST00000417226
aagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaa

SEQ ID NO: 9390 - DNA, 599 bp, Homo sapiens
  ENST00000510314
gaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtgg

SEQ ID NO: 9391 - DNA, 1952 bp, Homo sapiens
  ENST00000502878
gaggggaaaggaagcgacgcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtggg

SEQ ID NO: 9392 - DNA, 1763 bp, Homo sapiens
  ENST00000389735
gcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttcgcaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaattta

SEQ ID NO: 9393 - DNA, 774 bp, Homo sapiens
  ENST00000509551
cagaggcccgagcggacgcgaggcgacgcggagagggcggcctgggccgaagttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaa

SEQ ID NO: 9394 - DNA, 643 bp, Homo sapiens
  ENST00000511665
cggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtg

SEQ ID NO: 9395 - DNA, 2475 bp, Homo sapiens
  ENST00000274901
cctctcggcgccgccgcagtgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaagaaagtaagaag

SEQ ID NO: 9396 - DNA, 2532 bp, Homo sapiens
  ENST00000398661
acagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcagacttctcttctaacaaaccttcactgctttcagcccgatgtctctggcttctcagtctccttggcaggcacggtggcttgtatccactgggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaagaaagt

SEQ ID NO: 9397 - DNA, 2445 bp, Homo sapiens
  ENST00000370852
ctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggagcttcagtctgtgatgctgatgctgcaccatggacctctcaggaagccctgatccccatcatatttgagggcacctctccctcttttactaaaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctatttttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctaggaaatattcattaaaaccattgaaataaaaataaattcaag

SEQ ID NO: 9398 - DNA, 1171 bp, Homo sapiens
  ENST00000370850
agtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagca

SEQ ID NO: 9399 - DNA, 884 bp, Homo sapiens
  ENST00000508459
atcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttcc

SEQ ID NO: 9400 - DNA, 1314 bp, Homo sapiens
  ENST00000308161
tggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatag

SEQ ID NO: 9401 - DNA, 512 bp, Homo sapiens
  ENST00000507223
aaagaaataagcaccctggggaccattctagaggccactggatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaa

SEQ ID NO: 9402 - DNA, 2437 bp, Homo sapiens
  ENST00000428842
gccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtacttatgaaatcccacaaattctgttttgttaatgtttattgttaaagcttactcaaaaattatctagagattcttatatcatttataaaaatatacatagaatatcatatttctattttgtttaatcagggtaatcactatatagttacatctcattaacatcactgctgattattagtgagtatctagcttgtggaatgtgtcatgcagttgaaatcagaggaactagcatgcaaatctggcattattaactattttattaacactctagcacccaaatgcagccctcttatctcagcctacatgtgctgataagttggtataaactcacaacagcttttggaaaagaatcacctaatgtggttttcaaattttttttaaaacatgactttttcttcaaagagtattttatgtagaacttcaatagaatacagcagatataaaattgagctgctctgggaaatcattttatccattctttctccccctcaatggctgacttttctacttcctctgggtgatcccaaatcacctccatagtatcttgcagaacactgtttaaaaatacttgataaattgcttatagaagataaatataaactttcagttctctactattttctattatatgtgatttctataaatttaggagtatcagagatatcaatccctttctcctcgccttgcctttttcttgtggaaacttatcagctgttcattctaagagatgttgattacaggacatggaaaataaaaactgacccaagatccacaaacctaattttctctctcaggagtttagaaatggtataccaaacatggttacttgtattgaaagattatgtgattttgtcactgagttcactattttggggttcctaggatggagccacatgcaaaccagtgacaggacagagtagtagaaagcagaaatggaaaaaggaggctcctagcggtgatgagaggtatgggggagggaggagagggaaaaatctgccttggtgcttgtctgcttccaggaccaatagttgcctcaagtattataaccaggcctatgggttgtgaaacctataatgcatttttgtgtgtgtttgtttcttaaggaagaatttgtttctaagacattagctactttttctattaattttataaatatggagatatgatgaacacacatcgtaacaagttaaagtgcatagcgattggtaatagaaggttgaaagctggggatggatttgggtgcaggctgtacttcccttagttgaggtgagcaaagttcatggtagcgggaaagattcaacagttaatgagaaagataagtgagtcaattgtgactgaaaatattagtgaaatgattggaatttcaatcaaggtgttttgggggaacaattagagttagactatacctagtaaaatattttgttagtttgttttctatttatatttttcctgtcctccatagtaagtctacatgagtttctaaaatttgaaattacttttgtaattaagatagatgcatatcatgtaaggactatatgagaaaaatttaaaatccaaggcaatgtacttccaaagacataaaataaaggatatttatttttcaggcaaaagttacaaaaccacaatcaaaaaggagagatatactattggtttctcaattcgaatataaataagttgtctcaattttctttaaaataaagagaaagatgaagaccctattctacttcaatatgtgtttaaagtgtggagtataagctttaaagtaattctcattggaaagttaaaaagtatgtgactataagaagtaaattgcttatgtagcttgctcttcaaataggaagggtttttttagtgttgaaagatggatgcaaatataagttgtaggaagtaaccttttattatcttagctttctgttgtaaaatggaatagttaatgtaactgggctaataaaaatcttaaaccctcttaa

SEQ ID NO: 9403 - DNA, 569 bp, Homo sapiens
  ENST00000515546
agtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggagaaggagtagaaacattgaaggatgtaatgatcccctcagggttaagcagcttctctgttgcaatgtctaagctatggtctccggtttaggattcagtgttcgggctcttttttccaccaatagaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcat

SEQ ID NO: 9404 - DNA, 3395 bp, Homo sapiens
  ENST00000511206
ctttctttaatccagtagacaatgagaaacgctgatttgggtctatggcataataggaagtagtatgccacatactgcatgtgggagttctgcaggacagattgggaagtgcatgcgtgtaagactgggaagaccagttaggagaggctattgcactgttttaagtaagacataataaagccctgcaccaggcggagagcagaaggaacgcacagaagacgcaggagaggcacatttcagagagaatccagtatgcaatggatgtcgcacacaagagagagagacgcaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatg

SEQ ID NO: 9405 - DNA, 4585 bp, Homo sapiens
  ENST00000287936
ctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataa

SEQ ID NO: 9406 - DNA, 3681 bp, Homo sapiens
  ENST00000343975
cgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttgcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaata

SEQ ID NO: 9407 - DNA, 421 bp, Homo sapiens
  ENST00000509431
ggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtaatagttttacatatttaacttctggtgtcatcagatttttgatttgctgtggaaataaacctg

SEQ ID NO: 9408 - DNA, 527 bp, Homo sapiens
  ENST00000507942
agaacagttaatttctgcagtaggaggaggtcgatgtactccattcttaagtagtcgtttgaaatatttcaggatttgaggatattccttcttagacatggtcctgcagagtcgtaggaagcatttgtttctgggctatactaaatgtgcatgatttcggcgtcccacaaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcatt

SEQ ID NO: 9409 - DNA, 268 bp, Homo sapiens
  ENST00000442032
gagatcccgccactgcactccagcctgggcgacagagcgagactccgtctcaaaaaaaaaaaaaaaaaaaaattaatttttattgcagcattgcataaatactgtcaacttaatttgcaggagctatcctgtagcctgcttgtgacatttgcaactgctgatgaaggtggacgattgaattctatggcatgatccaaggattctgtagctacaatgttgtcaagactttttcgaatgcatggcctctttgtggcctcccatccctggg

SEQ ID NO: 9410 - DNA, 1107 bp, Homo sapiens
  ENST00000504466
aaggcttggcatcacctctaagttgctaattctatttccagtaagtggcaaggagcttaatgtactaatattttcatgttttgtccacctgcaggaagacaaatatatccttgtgatatatgcagcataaaaaataacgtagactttactagttgtatctttaatttttctctaaccaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaaggtaacttgttattctcttcgctttcaatccttcattgctttgtcaaaaagtagtctgttttcaaaattatgtgccgtgttgtgagatttcttttgatttcttgaacagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagaggtgaggat

SEQ ID NO: 9411 - DNA, 501 bp, Homo sapiens
  ENST00000515776
ttttttgcattaaatgaattattttgcagaggtatcttttaattaaaaactacagtgatttaatttaaaaattacattattttagcttagcattgtttgtattaaatggtttataacatgaaatacagtccttcaagtcttctgtttcatctctctctctgaccacaatttcattttttttctccatttctttagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaaca

SEQ ID NO: 9412 - DNA, 450 bp, Homo sapiens
  ENST00000508070
tggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagg

SEQ ID NO: 9413 - DNA, 637 bp, Homo sapiens
  ENST00000509085
ttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttgg

SEQ ID NO: 9414 - DNA, 487 bp, Homo sapiens
  ENST00000511986
tatttccctgaaatgcagattctagccgttagtggtaactattgtactgacaagaaacctgctgctataaattggatagagggaagaggaaaatctgttgtttgtgaagctgtcattccagccaaggttgtcagagaaatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttg

SEQ ID NO: 9415 - DNA, 603 bp, Homo sapiens
  ENST00000514315
attgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcaggtatgatgtatcaggcatagagtccacaagcctagttctgactctctgggtttctctttctatctgagactatgtatcactcacctctattttaattggtcttttccaaactcttttgtcatatcagcctaatccattgtgtccaaataagcatgtttaagcttatgcttagataagaaagtagatgaagagagcaaatgaatgt

SEQ ID NO: 9416 - DNA, 465 bp, Homo sapiens
  ENST00000512053
agttgatttagtaagaaattggtcatgattttaagggtgaatcttgttgtgtctctccctggctacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatc

SEQ ID NO: 9417 - DNA, 3506 bp, Homo sapiens
  ENST00000325110
gtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttca

SEQ ID NO: 9418 - DNA, 3466 bp, Homo sapiens
  ENST00000433297
attggctgtgggagccaccgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttca

SEQ ID NO: 9419 - DNA, 591 bp, Homo sapiens
  ENST00000508319
attagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccgggtaagtgctgaatctttcaacaagaatgtattgagaactgagtccaggcacagtggctcacacccgtaatcccagcagtttgggaggccgaggcgggcagatcacctgaggtcaggagttcgagaccagtctggctaacatggctgaaaccccatctctactaaaaatacaaaaattagccaggtgaggtggtgcatgcctgtagtcctagctacttgggaggctgaagtaggagaatcacttgaatccaggagagggaggttgtggtgagccaagatcacaccactgtgctccagcctgggtgacagagcgagactctgtc

SEQ ID NO: 9420 - DNA, 555 bp, Homo sapiens
  ENST00000514610
attgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaa

SEQ ID NO: 9421 - DNA, 950 bp, Homo sapiens
  ENST00000507004
tcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggtatgttacatgcctattccccgccgtcccccaaaatttttttctaaggttcaatagacccagatgacactttaattaatgcaatacgcaaacttttgtaatttgtccttgtttggatatattaagaaagatattttacctgtctgtcattatccgaattgtgaattggttatcttatcttgtaggacaaatggtctattcaaaatttagtcagatggatgacagagccttggcagatgaattttaaaaaaaaattagagcattttctttctttatcaaagaagggaaaagcatattctggggaaaatataacagacttcagtttccatgtttggttatagtgttgaattccttcttgtgaaataacaaaaaat

SEQ ID NO: 9422 - DNA, 708 bp, Homo sapiens
  ENST00000507293
ctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggtatgttacatgcctattccccgccgtcccccaaaatttttttctaaggttcaatagacccagatgacactt

SEQ ID NO: 9423 - DNA, 500 bp, Homo sapiens
  ENST00000511774
tttgcccgggaggatggggcaccgtgagcggggccgggcgggggttccctcgtgagggacctgaggccgaccgtagcggatctgagaagatccgagaacacaggcgagtcgcggaggggagaacgcgagagggcgttgaggtctaggtattctaacgacagaggagttggaggtgccagagaggcagctgtgaccgcctagagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagac

SEQ ID NO: 9424 - DNA, 1303 bp, Homo sapiens
  ENST00000288344
cgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 9425 - DNA, 4299 bp, Homo sapiens
  ENST00000486741
aatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttgattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccgtgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacattgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 9426 - DNA, 1552 bp, Homo sapiens
  ENST00000431390
cccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtagaagtttagcactgcagtcatcagaagaggcaagattaatttccttgacattgaggagttgttggataattactaaatttgtccttgttaaataaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 9427 - DNA, 1383 bp, Homo sapiens
  ENST00000380749
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 9428 - DNA, 2707 bp, Homo sapiens
  ENST00000492280
tgggaccccgcccccttcgcctgggtctggggccccgcgagacggcggaaaggggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccgtgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 9429 - DNA, 1045 bp, Homo sapiens
  ENST00000436324
atccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgc

SEQ ID NO: 9430 - DNA, 829 bp, Homo sapiens
  ENST00000380748
gcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaa

SEQ ID NO: 9431 - DNA, 850 bp, Homo sapiens
  ENST00000419378
cgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcata

SEQ ID NO: 9432 - DNA, 1014 bp, Homo sapiens
  ENST00000489072
ccgccggcgccccgccgggccccgcgaggcccaggccccgttgcacccacggtggcgacgggcccgggaggcgcttggagaccggcgggcgggcaggcgagcgctcggcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctata

SEQ ID NO: 9433 - DNA, 793 bp, Homo sapiens
  ENST00000482192
cctgggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcc

SEQ ID NO: 9434 - DNA, 709 bp, Homo sapiens
  ENST00000380747
gcttcacgcaggcctgcgaagctggagcccctggatagcctttcttgccgacagaggcgggagaaatttgctacttcctgtataccttatccttctcccttcccagtctaagatacgaactataaatgttcgaacccaattcaccccggaggggaggggccagataccagtggcctgaaggcgcccaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggata

SEQ ID NO: 9435 - DNA, 745 bp, Homo sapiens
  ENST00000485550
gtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattt

SEQ ID NO: 9436 - DNA, 405 bp, Homo sapiens
  ENST00000490032
aaacctcctgcaaaagtggaagcgaagccgaaaaaggcagcagcgaagaaagttctgtttttgtgatccttttaaaaataaagcttcacggaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatccc

SEQ ID NO: 9437 - DNA, 823 bp, Homo sapiens
  ENST00000443046
agcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagct

SEQ ID NO: 9438 - DNA, 508 bp, Homo sapiens
  ENST00000464078
agcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcagg

SEQ ID NO: 9439 - DNA, 527 bp, Homo sapiens
  ENST00000491183
cgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcct

SEQ ID NO: 9440 - DNA, 841 bp, Homo sapiens
  ENST00000479586
gcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaatttttt

SEQ ID NO: 9441 - DNA, 615 bp, Homo sapiens
  ENST00000471260
gggactgcggcccgcctctattcgtgcgtctccgtctccgcaggtcagctccgccgaaggcgccgccaaggaagagcccaagaggagatcggcgcggttgtcagctaaacctcctgcaaaagtggaagcgaagccgaaaaaggcagcagcgaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctcttt

SEQ ID NO: 9442 - DNA, 701 bp, Homo sapiens
  ENST00000482733
aggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctgtaagtaaagcgagccccgtaaccgttcgttttccgcgggtcgtcccgggtgaggacgctcagtgctgcttttgcctttcagaaacctcctgcaaaagtggaagcgaagccgaaaaaggcagcagcgaaggtaagcctcgaaacgcgcattgggatgcagcggggccttaggctacactgcttcttaatgcggggcttccattttgattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttg

SEQ ID NO: 9443 - DNA, 583 bp, Homo sapiens
  ENST00000463631
agcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctaaacctcctgcaaaagtggaagcgaagccgaaaaaggcagcagcgaaggtaagcctcgaaacgcgcattgggatgcagcggggccttaggctacactgcttcttaatgcggggcttccattttgattagctattggagctttatttatactttaataattacggtaaataatttttctagtggtcgaggcaaaaatgtaatggatatattcatcctggtttatagaactatatcacactaatgctgctgcagatgttaggagacttaggacgaca

SEQ ID NO: 9444 - DNA, 5881 bp, Homo sapiens
  ENST00000334082
gcctcccgtcccttcccgcgagcagagggagggaccgccctcgctccccgttctctccgcccccttcccgccccccgcagcccactctgccgccgcgctagcttcacgccggcggcgctgaccgggaaagcagcaccctcttctctgccagccggccggccggcggaggcggaggcagcggcaggcttcaggccgccggggctggcgctgctctgcccggcggtagccggaggcgggcgctgatggaagtgtgaagaggcggcggcggggcccggggaatgtgaggcggcgcgtggcggcggcgcggagcgtgagagacgaggagtaggggtgggggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagctgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatgtgggctacagtctcccatgtttttatttaactgaagcatatacacttcggtcatttatctccttgtggtcctgattttgtcagtactggaatgggaggcaggtcggggaaagtttgtttgatggcagtggattcttattgttgttttaaccattgcattt

SEQ ID NO: 9445 - DNA, 755 bp, Homo sapiens
  ENST00000460741
tcattatagggattctctactgtcattaatcacttaatttaagttatcctaacctttctatgactaagccatgtaaatgattatttttcccttttcctagttttatatctttgaagaatctattcactctaccttgagtgtcttaatatttctcaaaattaatttttatatatttattcagaatatactattcacttatttggggctatgtatttagcaagaaactctttaaagttgaaatttaagttaatctgtgttctcatttaattttaggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaa

SEQ ID NO: 9446 - DNA, 774 bp, Homo sapiens
  ENST00000282260
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaagtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 9447 - DNA, 815 bp, Homo sapiens
  ENST00000508576
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacataggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 9448 - DNA, 642 bp, Homo sapiens
  ENST00000535690
gcaagttttcattgggcaaaatgggttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 9449 - DNA, 1384 bp, Homo sapiens
  ENST00000221222
gggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 9450 - DNA, 1979 bp, Homo sapiens
  ENST00000539827
caataaccaggacaatgagaaatttacatctggatgtcagcggccaccaggctcctctcagagggccatctcctgtacagggtgttgtgggggcttcccctagacaaagaaagatggggtctgcttgctctgagttatctataataattatcttacctttttgtttctttttataatttctttcttttttgagacagggtctcactctcttgtccaggctggagtgcagtggcctgaccatagctcactgcactgcagccttgacctcctgggctcaagtgatcctcccacctcagcctccccagtagctgggacggcaggcacatgccaccacacccagctaattgtttaaatttttggtagagatggggtctcgccatgttgctcaggatggtctcgaactcctgggctcaaaggatcctcctgactcagcctcccaaagcaccaggtgtactttgggcctctcctgcctttttgattgaaagttccatgacgggcacacctggtgatgggtcctgagatggaacctgcttggcctccctcagcctggcctgagggacactcatagtccctcctctctccctaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 9451 - DNA, 1557 bp, Homo sapiens
  ENST00000392351
ggcggcggcggcgcagacaaaggcacgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 9452 - DNA, 903 bp, Homo sapiens
  ENST00000594794
acgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagc

SEQ ID NO: 9453 - DNA, 982 bp, Homo sapiens
  ENST00000594439
atgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccg

SEQ ID NO: 9454 - DNA, 1607 bp, Homo sapiens
  ENST00000542541
aaacgctgcaagtcgcagcaggagctgccggaccggaagggcctgggttccggggacccctgtgttccccaactcccacccggcgcaggacccgcccccagtccaggccagagctgccgccccacccccactcaggggctccggtttcagaccctgtgaccaggacagcagctgcccaggacaggatagggggggcatcccccctttgaccacagaggccgctgggccagggcctcccctcccccacctgtcttccccctcctccaaactcctccttggtcccctgcagattcggggttgctgaatggcccaatggggaggttggggagccctggtctcccagtgtggattctgctctgccctcatggtgggcattgggattggctgtttgtctacatcttgtctttttaacttggctgggggctccctggggatttggactctggacttcaaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctga

SEQ ID NO: 9455 - DNA, 570 bp, Homo sapiens
  ENST00000595756
aggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggtgtgtgtgggcacaaggaggtggggtgacggtgggtgacagtcacctcaacagacactcaggacaatatctacctaagatgata

SEQ ID NO: 9456 - DNA, 866 bp, Homo sapiens
  ENST00000596482
gcggcggccgcgtcgggaccggccgcgatgggaccggaggcggcgcgggcggcggcggcgcagacaaaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgaccc

SEQ ID NO: 9457 - DNA, 675 bp, Homo sapiens
  ENST00000600077
agcgcggagtcagcgccgcgggggccgcacccgactcgcgcctggacactcgcggggcgccgacctggcaggattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcga

SEQ ID NO: 9458 - DNA, 555 bp, Homo sapiens
  ENST00000599808
acctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggtcagggtggggtctgggtggggcagaggcaccaggagtcctggtgacaaccttgggtctggtggctggcttgctgtgtgcccaagggacaggaaaccctaagccttcccaggccctagtctctatctcctgaaagggttcagagtaaagaccttcaagaccctaatacaaggtaatacctggggggtttcatgtttgttagtatctgtcccatctaccttgaactttgttccccgaccctaggccatcatcaacagcactgtcactcccaacatgaccttcaccaaaacttcccagaagttcgggcagtgggccgacagtcgcgccaacacagtctac

SEQ ID NO: 9459 - DNA, 770 bp, Homo sapiens
  ENST00000599097
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaa

SEQ ID NO: 9460 - DNA, 1418 bp, Homo sapiens
  ENST00000433218
ggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 9461 - DNA, 1975 bp, Homo sapiens
  ENST00000331462
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 9462 - DNA, 586 bp, Homo sapiens
  ENST00000423674
cttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctgctggagaactcctggaacctttaagccctggctcagccctcagctctgtcccatcccagctgacctctgtgctctgcgcccgagctcctgagcccacgtgtagtcgccgccgccagccgccatgggcaaacagaacagcaagctgcggcccgaggtgctgcaggacctgcgggagaacacggagttcaccgaccacgagctgcaggagtgg

SEQ ID NO: 9463 - DNA, 1751 bp, Homo sapiens
  ENST00000307845
cgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggca

SEQ ID NO: 9464 - DNA, 1904 bp, Homo sapiens
  ENST00000381765
agcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagggcatggtctagtggcccagtcaggacgcggaaacactccctggaggttctgacccactccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 9465 - DNA, 4781 bp, Homo sapiens
  ENST00000419810
agggaaggggacggagttctctggagtcaggtctggggccaggagacctggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgggcatggtctagtggcccagtcaggacgcggaaacactccctggaggttctgacccactccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtgga

SEQ ID NO: 9466 - DNA, 587 bp, Homo sapiens
  ENST00000422133
gctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacgtgtccctggggaagccacccatggtcactcgctgcccgaatctgcctcctggcttggccctgcccacctcttcagagggcatcttctaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacat

SEQ ID NO: 9467 - DNA, 1535 bp, Homo sapiens
  ENST00000622018
tatgctgtgttcggggctgtctgtcggcgccacagggaatgggggctggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 9468 - DNA, 1941 bp, Homo sapiens
  ENST00000620771
actgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 9469 - DNA, 1547 bp, Homo sapiens
  ENST00000613496
ggtggtggccgcccttggggagctggcctctcagcacagcgccgggcaccggggctcaaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 9470 - DNA, 4856 bp, Homo sapiens
  ENST00000372844
ccccagacttgtaagccgggggctgagcctcagggcaggggtgcagatgggggtgcagccctcccgcttcccggcgactccgggaaggtcagcgcgggcaggcggggcgcgctcctgcggccgggcctcgccggccacccggtccccacctgaaaccccgcctgccactccgctccagaggagccaatagccgtgcaacctgcccgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 9471 - DNA, 4436 bp, Homo sapiens
  ENST00000612703
cgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 9472 - DNA, 4758 bp, Homo sapiens
  ENST00000617690
cgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggcggcagcaactgaagagcccacccctgggcaggagaccccccacctcagtccaggcccatgggtgcagagaaggaggcagagccgcctacttatccccagctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 9473 - DNA, 2363 bp, Homo sapiens
  ENST00000262626
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 9474 - DNA, 1783 bp, Homo sapiens
  ENST00000392226
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 9475 - DNA, 564 bp, Homo sapiens
  ENST00000600390
acgccaccgcctctgcctccaggccgcccgctgctgcggggccaccatgctcctgcccaggcctggagactgacccgaccccggcactacctcgaggctccgcccccacctgctggaccccaggcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgct

SEQ ID NO: 9476 - DNA, 1212 bp, Homo sapiens
  ENST00000597419
tccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggaggtgcaggtcagctctgcggacgctcggctcatggtctttgacaagacggaagggacgtggcggctgctgtgctcctcgcgctccaacgccagggtagccggactcagctgcgaggagatgggcttcctcaggcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaa

SEQ ID NO: 9477 - DNA, 1828 bp, Homo sapiens
  ENST00000599363
ccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggaggtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaa

SEQ ID NO: 9478 - DNA, 584 bp, Homo sapiens
  ENST00000596662
agcatggtgtctgttgcaggtggccggactgtgccatgctgctccagacccaaggtggcagctctcactgcggggaccctgctacttctgacagccatcggggcggcatcctgggccattggtgagagcggttcctgtgcctctgacctcccctggcccctgcagcctccagcctgcctgccctcacccctcccttctctgcagtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaact

SEQ ID NO: 9479 - DNA, 1820 bp, Homo sapiens
  ENST00000541345
agcatggtgtctgttgcaggtggccggactgtgccatgctgctccagacccaaggtggcagctctcactgcggggaccctgctacttctgacagccatcggggcggcatcctgggccattgtggctgttctcctcaggagtgaccaggagccgctgtacccagatgtgcaaaatgaggaccagagaggacatgcagctggggaacgaggggccaggaacagctcttagacttatccacttgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaa

SEQ ID NO: 9480 - DNA, 2175 bp, Homo sapiens
  ENST00000593305
agacccaaggtggcagctctcactgcggggaccctgctacttctgacagccatcggggcggcatcctgggccattggtgagagcggttcctgtgcctctgacctcccctggcccctgcagcctccagcctgcctgccctcacccctcccttctctgcagtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaactggtctctatttcctttctttctgtgtctccaatcccatctctcccagtgattgccccagaggccgtttcttggccgccatctgccaaggtgagatcctaaaactcagaaccctctcctttaggcccttggggaggccacgtcccctcaagctccccaggatggggccatgtactttcagaccccctagggcagggccaagcctgggctctggggacctgggctccagtcccctgtcgccgccccctgctgacccttgtcccacagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 9481 - DNA, 551 bp, Homo sapiens
  ENST00000600675
gattggtccgacctgagtccttgagtctggcagagtgccatggtgctctgtaatcccacctgtaatcccagcattttaggaggcagaggcaggaagattgcttgagcctaggagttcaagaccagcctgggcaacatagcaagacccgtctctacaaaacaaaacaaaacaaaacaaacaaacaaaaaaattagtcaggtgtggtggtgcacgcctgtggtcctagctactcaggaggttgagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctgg

SEQ ID NO: 9482 - DNA, 2295 bp, Homo sapiens
  ENST00000370552
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 9483 - DNA, 2121 bp, Homo sapiens
  ENST00000370549
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 9484 - DNA, 1760 bp, Homo sapiens
  ENST00000628193
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaga

SEQ ID NO: 9485 - DNA, 1849 bp, Homo sapiens
  ENST00000370546
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaaaacccaaagatgtcaatactgtgggatcatctgaatctaaaagggcattacctaattcttcagaagaaaggtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataa

SEQ ID NO: 9486 - DNA, 3681 bp, Homo sapiens
  ENST00000404542
tctgcttcttcccagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaactccttcttctctgcctctttcttgctgctgccctgagttttttgacacatctctttccataggggagtaatgggtgtgtcagccctggcctgctgggagagctgtttgtatgatttcccggctgatgtatgagcgtgcgcatctgggttcctgacagtggcatccatcactggcagttcttctgggaagcgggtgcttcaaaagtaaaattacaatcacactccagatttggtaagaaggttctattcctctgtgaatccagattcccccagagttgtaatgggagtcaagtaacaatattcattgagtggagagcagtttattaggcacaacaaaaagtagtcatcattcttcatgttgctatgagggagagtttgagtacaaagagaaagcatactgaaacatcaggtacacacacacaccccaactggacaaagcaaattagacctctccaaaattaagagaatattaggggctctatagggtaagcccttaattgtttggttaactcaaatcattatttttaaaaaagaagaaaaaagtgtgaatcaaggtcatcactggaagacacaactgaatctaacctttttgcctcttcccaagtagcctatttgagctagaacaaaactttgttagccattttgggagagaatagggaatctagagaatgaagatctggccaaaactatggaatggtaggtaggaagcttctgagttgggcaggtgtgaagtgggggatgaggacgttctatatgattcaaggggcatgagggtctttgccaatgagctacagctgaaatgactttcttttctgtggatgtgattttctttctcaggataaatgacaggaatgatgcttttgttagaaggaggagagatttgacactgttccaagtgagacggtgatacaatttctgctgtttgtgaaaggacaggaatggggcgggggcaaggcagggttgcctagggcagagactagggaggctgcctaagacgcacacggagttaaggatttgggccaagtctgcaaagtgagagatggaagggagattagaccaaagaggagggagagaattctgagcttggagaacggtggatttgggagagggaagctgactacctaattccaggaagcgaggggaccgggttttgacatgcttatcattaagcacaggaggaacagcatacagcagatgtactacagcgagcaagaaagggagagcccgaggaccaggctgcaccaggtcagtggctgtgctcagcatggaagcaactggagagagaggggcagaccctgagaccgccctgcaaggctgcccagaagggacccgtttctctgggaccaggcacctcccactgaggcttcagctctgagagggcaggaaagtgaagtaccaagatgggggcggggcggggggtaggaaataagagaaagaagaaacagattgacaggccaaagtgaggaaaagagaggaaaagagaaatgagactaaaaggtcgttcccccaactgttaaaaatgtgtgcagatatcaacgtctcttctacatactggtacaggtgcgactgcagggccccctgatataacaagagtaaccaaaggtccctaagagcctggccctggggacctatggtttgctttgcgtccttagtaaccccatgataaaggggtactactgttatccccatttttcctacgaggcatggagaggatccatggctcgcccaggggcacccggggaaatgggttgccgagcgcgaaataatccagagcctgcccactcagccacaaggctcagcggctccacaggtccagacacctccttcacatctttgtaggttctgctcattcagaacagccagaactccactcaaacacactttctgtaaataagtgttgatttttttttactaaaccttgcagaatatgggtaattcctgcttcttttatctttctctgtgtattaaatgctgctctcacgagatttaagttttgtttattttttagttaataaaaggaagagggaattactgaaattta

SEQ ID NO: 9487 - DNA, 447 bp, Homo sapiens
  ENST00000614306
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggat

SEQ ID NO: 9488 - DNA, 1066 bp, Homo sapiens
  ENST00000264735
cgggcgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgggaccgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctta

SEQ ID NO: 9489 - DNA, 498 bp, Homo sapiens
  ENST00000416012
tctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtggagacagtcttaatcaagttgtgaaatacagcaaattgtaaagggttgtttggattaaagggttgtttggaaaagctgggtcagattctagcagagaacc

SEQ ID NO: 9490 - DNA, 2561 bp, Homo sapiens
  ENST00000377291
gtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacagaccatggctttgccttccagaatgctggtctgtggaactgacccattcattcattcatttgttcattcattcatttgcaaacattcatccaattcccaccacatgccaggaattatgatgaatactggggatgtagaaatgagattttttgggtttatggtgatgaagttacagaaaatcaatggcacagccctggtctcagctctgccgtcactcaacttgtatcttgagcaagttcctccccatctcaggcctcagtttcctcatcgcatagagagttggtcttccctcaccgggcttcctacttgccctccagagttgcctgaagctcacatgagcgaagggacatgaacatgctctgccatctcccaataggacataagtccacgctggagcgctgagcatcagactcaagaaaagcttgcgtggatattgcagacccaccaacaagggctccaggttctggagttgtggaggcaaaactgcctagtgagaaccctacatattccctctggtccttgcagctgccacccccattcccaggggtggagtgtccctccatagacttggatcctgggccctctgctccttcaccactgtccatctgaagcaagcctggttgctccggcactgaactgtggcctcgggccctggaccctgcccctcaaatccaccctccaagtgcacacctggaaacttccgcttccagtcctgatgggtaaaacgcccacctaccatatccttgcgcaatctcttattcaggaggcagctggagtgcaaagctgacttagttcacaaagtataaaaaaatacagggatgtggttcagctagaa

SEQ ID NO: 9491 - DNA, 4225 bp, Homo sapiens
  ENST00000624694
cacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacagagagtttggggagtgagagcccctcccactcctggagaggaagtcaggggaaggagagcagagaggaggtgggaagccctttacagcctcaaaagtcaaggagaataaatcgtggccccccaggagtcattgaaaggaagccagcactgtcctgcactacgtgctccagcaacctcctgagctgctgcaagagcctgtgggggctcaggttccttcagagacacatgggaggcccctcggaggagctatcgggggagccactgtctgaggagccacagaagagacctccccagaaagcggtgaggacgctgccctctgaggctgtctagacctagccccaggacactgaagataccgctcccggtccccaagatgtgactcctggagctcctaaggacccagtctccaaagccaccaaggactcaccctggactgaatctgggggctcccagaacacacagctgggtgtggggtcctcaggcctagggcggaacagcctattctgtgctcagcattcccagacaggcacgcaagactcctctgggcccgagtgggctgaatcccatgggttcaaagctcacgttggtgctggccctgggagtcatgagcagagacggtgggacagacggggatgcgtgcacatgtgtgtgcatgggtgcatacgtgtagggacgtgcatgacctctgagcaaggcagagggtattgaagaaagcattggcctctcactccctcatgggttctgcaggatgaaggaaaggaaaggaaaagacagagaaaggaaggaaatagcttttcatgagcacctactgtgtaccaggtgcttccctggcatgagctctcgtaacccttatagcaacatgagtttagagcaagaatcacaccccgactttacagagatggaaactgaggctcagagaagtaagggacctgcccaaggccactcagcacctagaaagtgtgcctagcacataggaggcacacaaaaatatgtgttgaatgggtgaatgaatgagagaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtccaagagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccacccagtccaccccctacctgacagccagagtgggccatgccagatgcaacccaggtcatgccacacaggtagataaaaccatcttcagcccagccctcaggccctgtgtgctgggaccctgctgggccctctccagcctccccctgcgccaggcctcctccgtcacttcactctggccctgctgttcttttccttttagtttgattaactcactctgcccattccatgctcaaagctgtttccgtgaggaaaggctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagctctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttac

SEQ ID NO: 9492 - DNA, 4067 bp, Homo sapiens
  ENST00000636584
gtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggaagccagcactgtcctgcactacgtgctccagcaacctcctgagctgctgcaagagcctgtgggggctcaggttccttcagagacacatgggaggcccctcggaggagctatcgggggagccactgtctgaggagccacagaagagacctccccagaaagcggtgaggacgctgccctctgaggctgtctagacctagccccaggacactgaagataccgctcccggtccccaagatgtgactcctggagctcctaaggacccagtctccaaagccaccaaggactcaccctggactgaatctgggggctcccagaacacacagctgggtgtggggtcctcaggcctagggcggaacagcctattctgtgctcagcattcccagacaggcacgcaagactcctctgggcccgagtgggctgaatcccatgggttcaaagctcacgttggtgctggccctgggagtcatgagcagagacggtgggacagacggggatgcgtgcacatgtgtgtgcatgggtgcatacgtgtagggacgtgcatgacctctgagcaaggcagagggtattgaagaaagcattggcctctcactccctcatgggttctgcaggatgaaggaaaggaaaggaaaagacagagaaaggaaggaaatagcttttcatgagcacctactgtgtaccaggtgcttccctggcatgagctctcgtaacccttatagcaacatgagtttagagcaagaatcacaccccgactttacagagatggaaactgaggctcagagaagtaagggacctgcccaaggccactcagcacctagaaagtgtgcctagcacataggaggcacacaaaaatatgtgttgaatgggtgaatgaatgagagaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtccaagagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccacccagtccaccccctacctgacagccagagtgggccatgccagatgcaacccaggtcatgccacacaggtagataaaaccatcttcagcccagccctcaggccctgtgtgctgggaccctgctgggccctctccagcctccccctgcgccaggcctcctccgtcacttcactctggccctgctgttcttttccttttagtttgattaactcactctgcccattccatgctcaaagctgtttccgtgaggaaaggctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagctctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttaccatcgtgttccaataaaactatcgaaacaga

SEQ ID NO: 9493 - DNA, 1080 bp, Homo sapiens
  ENST00000231683
atggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaa

SEQ ID NO: 9494 - DNA, 2659 bp, Homo sapiens
  ENST00000340177
cggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtattttttta

SEQ ID NO: 9495 - DNA, 1419 bp, Homo sapiens
  ENST00000317393
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaaaaagatgaagaagaaaacatgtctgtga

SEQ ID NO: 9496 - DNA, 900 bp, Homo sapiens
  ENST00000611492
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagctccggcagctcctcgaggggcactgagaggccgcgctcactcaagaggggctccaagccgtcggcgtcctcggcctcgctggagaagcgcatga

SEQ ID NO: 9497 - DNA, 8031 bp, Homo sapiens
  ENST00000002596
agaacctcccagcttccggaatagaggagcggggcagaaatatcctgctttttatttcagagctgacgtttgcaatcctagtgcactagcggaaaaaaaaaaaaaaaaaaaaaaaaaaaaaagctgaattttccgcgctctcctggcaaattggcgtccgctctccgacgctaaaccaaaggaaaaggagtgttcaatggcgacagggcgctctttgaagccggctcctcacgcggattctggcccaggccgccgctccggtcccagtccggctgcagagcgaattggagaggatggcacctcctgcttcccggggggcggaaggagcgccagcgcctaaggtgggtcacctgccaggaagggaatacgcatggtgcagactcacgtgggaggagcacaggtcccgggtacaagtgccgagctggcgacttagagaagaggtagactcgggctcagaccaagcaggcgtaagggagtagacgggacgtcccgtgtttgcagtgacggcggagtcacccatcccagcagcctcaccttcttggagcgctggtccctccccttggactgaaaccccaggggccaccgcaccgggtgggcgggaccgactactacccgaccagccgctggagctgcgtgccaggcggggctgtgcggagcagctgagcgcagagcggagcaccaggcacctagcgggccggactctgggcggcacccgagcgggccgggcagcagtgggcgctcgcgatcctcctctgcccaacgcgctctccctccgggcccggcctcctccgtcccctccttttgctcccgctcctcctcccgctcctccccctcctcgggattgagcaccaaaacgcccgcctgcaaggtcctctgcgccctggcagccaggagtcgccgccacgacagccgggtctcagtgggtgcctgcgccttctccccgcccgcctgccccgggccatccagaaacttgctctacccgccgcgggtgctcggcagtgctgcccatggcccagcctaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctgagcagccagcttgttggagatggtcacataaacccttcttatcctcagttttttcatgcattcttcatgcagtcagccttttacagaattaaacccattggattttaataaaaataaaacattcattacagtaaaagagaaaatacaaacaagcaaaataaaccggcttcctgacatggtttataccgcaggaaaatgacagaaatggacgttattaatcatctcctacacttaagaactcattgaaatttctccaagcaaccccaggatgcagatattattatggaaatttcaaagaggaggaattaggcccagagaacatgagaaacttgcccaaggtcacattgactataaactcaggcttagaggctactcagagccaaagcacaggttatttatgtatttagtttttacccaactctttctgaactcaaaaggaaaagcccagactcagagccagttcttcctgacctgacttaacatttcttcccaggtgccaaatatcttccatcctaagaggtgtgtcccagatacaggaagggcaagaagaagcctgcatttttctcagcagtgttatcagggaagtgagtcaccttggtacgtttcagcagctccagcctgacctgaccttagcatggcctatgccccaccccatatcatgaacagagagcagagaggatgccttcctctttagaatccattgaagttgtcattaagccatcatctcccccagaggaagtagcagaaatatttacagcaggcccctggtggacatggtacttttcaataggcagagagcctccctctgcagcacatcgttggatcttgcttttaccatactccttgaagagctgaagaaataagagggcccagcaaggttaagtcaagtttccaagcctgttcaggaatatggtgactgaaaggaaactgcaatgagagtctctgactgaagaagatgctctttgcaaactgcctgtaaattcctgtcccctgacagggatggtctggtagaagcatgaactgtggatgcaagaggcagcggggaggagtggaggaagacaggaccagcacatggaatataatctagctgctgggactggcatagtcgatggaggcggtggtccagtgtaaaatgatcagtgaatgtaaattcaatatgttttcatttgggggtgcagagtcgtggctaaaggaatgttcaaatgagtctaccatgagcaagggatcagaggtcctagtggcactatctgttcattcatttttggtacaaccccagccagtcattgagaaggtacactgtgtaagaaaccatcactccagacttacccaaggtatttattgctagatctcaccaagcactgtcaaattcaaaggaggccctgtagtagaccctgggctgtccttacagggccaaaatgcagtgactcaggagcctaatagcacccggtccctccaaaacatgccttctaccaattccattaacagagacaggtgtcagtggaaggggtgggtctcctgtccagaccaccccggcccgggagcagcctgggggatctaggtgggtccttccagagaggcaagtgagaacaactgaaccaagcctcagctattagatttggaatattcacacacttgacactccagagtcagaacagccccttccctttcccttcctcctggaatcagatagggttgaaatccttttaacaccatttggttatcagctcacaacctgaaggtttgcaagtttaggaaaagtgacatgcctctgagcacagggtgctttactccttctgtgcttggaggcttacccaactgaaaggagatggagggcaggagaggccgatgcctagcgtgcctgctgcttacaggggtggtgtcacaggtcaccattattcattaaaattttacttttttgatcccctaccacatgctcaacatggtattgagtcctcaagaatataaaaagaaaatacaacaggaaccagtagtcattaactgtttgttctggactttaataaaagtacagagggtcttggagtacaaaggcaaagacatttagctgtgtatagaatgggtgggggaatgtgttccatggtttggcattcagttcagcaacattcctgagagaaatcaactagcccccttatagagaagaggaaactgagatttaaaaagtggtcctggccgggtgtagtggctcacgcctgtaatcccagcactttgggaggccaagacaggtgaatcacgaggtcaggagttcaagaccagcctgaccaacatggtgaaaccccatctctactaaaaatacaaaaatgtgccaggcatggtggcgagtgcctgtaatcccagctactcaggacactgaggcaagagaaccacttgaacctggcaggtggaggttgcagggggccgagatgatgccactgcactccagcctgggcaacagagcaagactccatctcaaaaaaaaaaaaaaaaaaaaaagataaattaataataaaaaaataaaaaagtaatcctgacttcaagtcatttttttcagaagaaaggattcttgctcactccagggaaatagtccagaaatggaaaatgttgacatcacaaatcacaaaagaaggtgaaaaatatcagagaccctctccagaatgtcatttctcagaaatattaagaaatagagaatcttcccagaggtcgcatgtcagggcaggtcacttaacttgtgggccacagagaccctgaccttcctgtgggaaggcttcatggaggaattgccataaagctggggcacgcacgaatggcagtagtgtcaccagagcagggcattctgaacaagggaagcttgagacatgaagacagtggtcacggggagaggctgggggtagagggtagaggtaggcaagagatttgtctgagtggcatgtcaaatgtgttaaactcaatgagaagctactgctttccaaggctggagtgttggaagcttacttagcaggcacccatgtgaatttggctcctgtgcaggtgtatctgttgcataaaaatagctatcatttgttgcacacctgccatgtgcttggtattttaaatatattgcttctaacctatataacaaccctaggaagtagaaaatgggctactaattttacagaaaaataaactcagaaattaaagggcttgcccatgttgatagagccattacttcttacaaatgaaattttgtctccgatgtctctgctccttttcagtccatctatttgtgggtaagtggaggaagatataaagcatatgcatctgtctattaggcagagcctgtaagggaaattatgggcatctaggatttggagttggacagttagggtgatatcaagattaccttcaagcaaagcagtggctgggatttgatgcaacagggacgtgataaaacatgctcctaaccggcagcagctcatttcggaagactgagcctgagttaaaggccagagcaacataacagagttctccaaacagcacacagtgagagaaggccaaagctaaagaggacatcatcggatttagctgcttcactaaagtgttttgatgtagaaaatgaccttggtgctttagttatccctgatgtcaagacctttactctattttgcccaaatttctcagttagataacagcaaagagagagagccagaagacctgggtgtgcatcctagctgtaccaatcactgaccatgggatcttagattcagactctgagaacctccatttccttctccataaaaatgggcagatatgtactgtactctgttgggggaaaactccaactcaatgagataaagtaggtaaaaactataaacccagtgcatatgttacttagtggttaaaaacatttgggactttaggagacagaccaaaactggttttgaaccagtcggcagaaatgcgctgccttttttcctcctctgcttcccagctatgtgactgtagctattgctgttaatgctccatccagagctcatttaccagggaagtgctctcaaccccagctgccacaaagattgtcttctgtactattttctgaaggatttctcttagttggcaggagttttcttacctgaagatgcctgagaaatgttgtccaccccactcccctgctttcctagggttagggcatgactaatgattgactgacccatgtgggatggggcatgggggtagtagggtaacagtccaccctcattgcctccaggcaggacaacctctggtgcaactcatgctcagagctcctcgtgagatcaggctgaggctagacttctcctgaaactgtacttttacttatttcttccgaaacttcatccttttcccacattaccttactcatttcttctgctaccctattctcagtaaatgtgtttcccaagaaaacaggaatcccccctcagactttgcttctagaccatccactctaaagtcttaaccttgcatgcatgttttcttctctctgtattttacatgtataacgtgatcaacccacggagttattagaattcttccaattaaatgagatatagcagagaatgagtctattttattggctagcaaatagcaaagtgttaaattcaataatggctgaaattgttaccaagtagtaggctcttttattagcttatcggactaccaaaatagtataatgcatcaatatcaaacttaaatttcaacttcataaaacaattctgggcccaacaaatatgaaggtattgctccatcttatgtagcaacatcttgtatttctattgtttgataaatattccacttagaactaa

SEQ ID NO: 9498 - DNA, 491 bp, Homo sapiens
  ENST00000514690
ctaagaagaatcgaggctggagcaggtggagtggatgcagagggaaccaggaagcaaaggctggggattttcccatcctcctcacctcctgccctagcacctctgctctggaagtcccgagggaccggttgatcttaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 9499 - DNA, 496 bp, Homo sapiens
  ENST00000510712
gacagggcgctctttgaagccggctcctcacgcggattctggcccaggccgccgctccggtcccagtccggctgcagagcgaattggagaggatggcacctcctgcttcccggggggcggaaggagcgccagcgcctaagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 9500 - DNA, 2314 bp, Homo sapiens
  ENST00000261374
gccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaa

SEQ ID NO: 9501 - DNA, 2266 bp, Homo sapiens
  ENST00000473392
cccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggtgactcagacactacctgtgtggttgtcggtgcacacacttgggtgattgtgctgaagctacctggactggagacaagaatgtgtgtcttgctaaactgtggatgataattaaattcatggaagcagcagcaatgacccaggagcacgtatagctggagaagaaggtcagagggtctcactctgtcattcaagcttgggtgcagtggaatgatcatagctcacttcaacctcaaactcctgggctcaagcggtcctcccacctcagcttcccaaggagctgacactacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatat

SEQ ID NO: 9502 - DNA, 3203 bp, Homo sapiens
  ENST00000331351
cagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctgatta

SEQ ID NO: 9503 - DNA, 772 bp, Homo sapiens
  ENST00000475436
gctggatctgcattaaatgtcgaaaggaaggcggagaggggtgagacaagaggtgggaggtgaggcaggtgggagcctgaccctggagaaccccgcaggtggtgcttctgactttcagtttcagctttgacaccagcatggagctgactgtttgtcctttgctctggtatttagagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactg

SEQ ID NO: 9504 - DNA, 4441 bp, Homo sapiens
  ENST00000370836
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattac

SEQ ID NO: 9505 - DNA, 2607 bp, Homo sapiens
  ENST00000521489
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagact

SEQ ID NO: 9506 - DNA, 387 bp, Homo sapiens
  ENST00000602570
cctgcagcagaatcacctggcgaggaggtgcctgttgaaaaagataagaagtttcattcagaaaagatgaccctgaaatcctggagcttttgcccaaaaggctctgaaacatgcatcttgcctatggagcccgcatcctagcctgccttacttgggctgccttgataccatcccccatcagtgtgacaatgatgattctgggcacgtacaagcctctttcccaggaagctggagcaccaaatgacagctgtgtttgagggatggctccgttgacaactgattcagaatattgacaagacttcattatgtttttgctcttgtgtttacatctttcaagtgtgtttgaaaaatcaagaaaacaatacaatttggtttcccaaattgaaa

SEQ ID NO: 9507 - DNA, 1938 bp, Homo sapiens
  ENST00000370833
atggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaa

SEQ ID NO: 9508 - DNA, 1818 bp, Homo sapiens
  ENST00000406696
atggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaa

SEQ ID NO: 9509 - DNA, 831 bp, Homo sapiens
  ENST00000640529
atgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagatgcgtcccacacatatggaattgggagcagtcatttagcatctcttataacaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccagtgcgcatgctctccgacc

SEQ ID NO: 9510 - DNA, 1885 bp, Homo sapiens
  ENST00000358290
tggtgtaaaagacaatcgcggccacacaccgcgtgggggctgcgcaaagcagaactaggaagctttgctccggtctggacttcgtccctcccagatctctgagctagcaagcactgcagcccgagccaattgcgaaagaccaacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaa

SEQ ID NO: 9511 - DNA, 843 bp, Homo sapiens
  ENST00000507518
aacctctgcctcccgggttcaagtgattctcctgcctcagcctccccagtagctgggattacagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaac

SEQ ID NO: 9512 - DNA, 641 bp, Homo sapiens
  ENST00000512344
cctgtaatcccagctacctgggaggctgagacagaagaattgcttgaacccgggaagcagaggttgcgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatga

SEQ ID NO: 9513 - DNA, 571 bp, Homo sapiens
  ENST00000502576
agataaagaaaggagttggggaccatccgagtcatcgtctgtgattttataaagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaat

SEQ ID NO: 9514 - DNA, 851 bp, Homo sapiens
  ENST00000507286
gatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataag

SEQ ID NO: 9515 - DNA, 569 bp, Homo sapiens
  ENST00000513854
cctgatcaacatggagaaaccctgtctctactaaaaatacaaaattagccaggcatggtggcacatgcctgtaatcccagctacctgggaggctgagacagaagaattgcttgaacccgggaagcagaggttgcgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggtaagtgacagttaagaaaccttagaaatgaaaggtaaaataacaattatctattgcattttttactgacatttaaatcaggcagttgataaagtacagttaaatggaattgacttaataaaaataacaggctcaataacattgaggcaagattgatacagctcttgggtaaatgaacc

SEQ ID NO: 9516 - DNA, 563 bp, Homo sapiens
  ENST00000508413
agttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagagtctcgcactgttgcccggactggtgtgcggtggcaaaatcttggcttgctgcaacctctgcctcccggattcaagtgattctcctgcctcagcctcccaagtagctaggattacagcatggactggaggaaacagctgccaaatgcaagggactgggtgccaaggttcatacctttgtggtagactgcagcaaccgagaagatatttacagctctgcaaagaaggtgaaggca

SEQ ID NO: 9517 - DNA, 2571 bp, Homo sapiens
  ENST00000278353
actggcggaaccccgggggacgcggtgatgggaggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatg

SEQ ID NO: 9518 - DNA, 559 bp, Homo sapiens
  ENST00000527433
atatggccccgcgggcggggtttaggcccaaagtggtgtcggagcagcgcctattagtgtcatcctcaccgtcacggccggcgcctcctcctggattcattcactcgctcttttcattcacgaagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactc

SEQ ID NO: 9519 - DNA, 611 bp, Homo sapiens
  ENST00000531185
aaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaacc

SEQ ID NO: 9520 - DNA, 563 bp, Homo sapiens
  ENST00000636007
attcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacct

SEQ ID NO: 9521 - DNA, 994 bp, Homo sapiens
  ENST00000395700
cactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataagcaattatacttgagacctgaattacaatatggcaaagactcttaactaacttctactcaatcaaccagatggataaaccaatgctgttcatttgtttggtaaaacatactaactgatgtccccagtttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtattta

SEQ ID NO: 9522 - DNA, 540 bp, Homo sapiens
  ENST00000636722
attcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcaggtgagtcggatgcagcgccgcgtcctcgctcccgcggcggcccggaccaggcctgggccgtgatgactagttctggggtctgctcctggccttcccctccccagctctcctctttctcaggctcctgtgccccgcgggcccctcctggctcccttggctgtcttctgcttgcttagactacttgcagagttttaagttgtcacaggtagtactgatggaattggaaaatcatatgcagaagagttagcaaagcatggaatgaaggttgtccttatcagcagatcaaaggataaacttgaccaggtttccagtgaaataagtaagttctcacatcaaacaaaaggaat

SEQ ID NO: 9523 - DNA, 866 bp, Homo sapiens
  ENST00000637401
attcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataatgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagc

SEQ ID NO: 9524 - DNA, 546 bp, Homo sapiens
  ENST00000638034
attccgtgttcatggagccagtcagtcgccctgctgcctcctcagtcacacgctgtcctccttggttcgccccttttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatt

SEQ ID NO: 9525 - DNA, 571 bp, Homo sapiens
  ENST00000527213
attcatctatctgcatctgcttacacatctctacttattgtctgatatgagaagctgttatagatcactaagctgaagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatga

SEQ ID NO: 9526 - DNA, 403 bp, Homo sapiens
  ENST00000532178
agttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttaggttgggctggcttaaagccccagccctctagtcacagagttggtctttctggtgtccaaccccatcctgggtcatcttgattccactactgagtatatatcaaaaacgaagaaactcaatatattgaagagatatctgcactctatgtttattgcagcactattcacagtagccaaaatatggaatcagcctaacagtctatcagcagatgaatgga

SEQ ID NO: 9527 - DNA, 2507 bp, Homo sapiens
  ENST00000533090
tatttctaggaaaacaaaattcccttctcatcagaatgctgtctactttaattaatatgaagtattattcaagatagaaacaacaaaatttctatgcttagcatgcattgaaaccttattattacaaaacagcatctgtttcttagagaattgatgatatccaggagtcagaaattcacgttacagcctcggtatttaactgtgaggtgattttgactaaaccattggacttctgaacttttcttggttaataatatatcaaaacagagtttaaaaatagcccctctcattatatgtatttagtcaacaattatggagtccttaaaaaatgcagatgtcaccttttcatgttggttactagagatcacatcttaactctctttaaggatgagttttacttacagctaactagaccaacaagagaaatgaatgtgaagttacacttactctttgccaacctaccactttatcgtattcttttaaagactttttttggctggaaaagtttatgtgagctcttgaggttagaaagcttaagtcatcttggtaggcaggatatttcttctgataacatatattcttttctgagaatgcattttgggaaatgtagattttcactgtaaatccttcattgtttgaagaactctgtgccagtattacatttcaggcaagactaattttagccaggttcattaaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtatt

SEQ ID NO: 9528 - DNA, 511 bp, Homo sapiens
  ENST00000533802
catgtgctgaatgtttgcaaactttcttccacaaagcaatatttgtacaatatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgc

SEQ ID NO: 9529 - DNA, 583 bp, Homo sapiens
  ENST00000534053
atgttaaaataaaggtgtatgcagggaatataaaagatctgtaagtaaaaattctcagcactgtggctagagaagacctcagagggtagagatcaactcgaggagactggagatctgatctggttatgccctgggttactaagactgggaaatgagctaatcgtgaagaagagctatttttagttgattgaattatgtctcatttactgaccaagcatagcacatactgatgaaaggcagggagagatatgtggtagaaaaacagctacattattctgtttcgaataattatatatctcaatctgtaattcacaaacaactgcatactgtggcttcactccttttacacggtacattttcctttttagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccct

SEQ ID NO: 9530 - DNA, 4292 bp, Homo sapiens
  ENST00000525736
actgccttgattttaaaccatcgtggaaataaatatactttctagaaaagaatttacatttcttagctggaaaaacataacccaacttggaattcctgagtatgcatctcttgtccccaccccttgatctgggggttctctagactagctctatggtttagctgcatgaagagttaacttgtggcaccaccaagtggttcagtcaggcagtgcaacttaattctcctacaagatcaaagtagtccaatttataccatgttacatacgaagggagggaagaagatggcaaaaaggatggacgaaaggaacaaaaaattataacgcagttgagaggtataatgattagaccatctctacctctagaagctcaaaatcttacaatacctttaccaggcttgtgatctatatttgggtttttttttttaatcttcactattttgtgacctttaaacctaatgcatagaaatgagaaatggtttgcttatgttccttcattatgtgagatcagagtatttacatatactctttctttccttactgctcaactttactctgggaaataaccttttctttactgacccattgtgagagcctcactgaactctgcatttcctactcagtctgagtcggagatctcaccctagtgtgtgctctcatagactatatccttgtggcaaaatggtccttaaaagatgtgacaaaaaatttttttttctaagtgagggataaatatatagtgataatcccaataaacaaattctcagaaatcaaaagttacctaatcaaagttggctcaaatattgaagtacttcatacttagtatgagtctgtggctgcagcaacaaggaaagaggaagatagagagtgacagcactccatctggggttcttggttctaatgaagaggctgaggtttcatctaacctgtcaaggagagtgggttgcattccttgacttagacttcggagtgggaaaaatgcaaagcacacacgtacataaaaacccagagacggccgggcgcggtggctcacgcctgtaatcccagcactttggaggccgaggtgggtgcatcacaaggtcaggagatcgagaccatcctggctaacatggtgaaaccctgtctctactaaaaatacaaaaaattagccaggcgtggtggcgggcgcctgtagtcccagctactggggaggctgaggcaggagaatggtgtgaacccaggaggcggaacttgtggtgagcagagatcgcgccactgcactccagcttggggactctcgctgagactctgtctcaaaaaaaaaaaaaaaaaaaaaaaaaaaccagagacatgggaccactccttctaggtctcagcaggacggaaatccatagaatggaacagatctcaatttgattgaaattttaagattttgaccaccatgtgttagaaccattccttttctttaatggaagtgtcattgggccaagcgtggtagctcacacctgtcatcccgacacttggggaggctgaagtgggaggatcacatgagcccagaagtttgagaccagcctgggcagcatgttgaaaccttgtctctacaaaaaaaattttaaattagctgggcatggtggtgcacacctgtggttccaactactcagaaggctgagacaggaggatcccttgagcccaagagctcaaggctgcagtgagctatgatcgtgccaccgcactccagcctaagcaacaagcaaaaccctgcctcaaaaaaaaaagaagaaaaagaaaaaaagaagtatcattgcagtgatacttcacacatgtgagataaacaatacattcactctttgttgaactaccatgcccaggttatttcaaactacagaaggacctcttgtatcatgactcaggacttgttacaatagggtttccttatactctgtgttgaatcacatccaaaatgcagcaagcttaagcaataaagaacctaacattattgaagttcctctaaaggtcatgtccagatttgtcaccctacacccatccagtcaggtgtcttttagttacccaaacagtttccatattgttagactgtgtttcttctaaaaaagaaaaaaagggaggtggttctatcttatcaataaaattgtttataaaactcagaagtagaatggtgagaaactagggaagaaaagtagtaacgcaagtctgagaaataagatgtctattttagaaggatcaaagctgatagaacaagcttaattagccataaattatggagaaagttggcattatcccattagaagaataaagtatcaaagatctcctacttggtggttctgtctcaatgttgagtttactaagtgtgaaaagtatcctatcctgaatctgtgctctctggattatttaatgctttcctttttaaaggttcaaaaaggtagatttctgcttatttttaatactttctctggtctcaaactctgttttattgagagattgatttgttacaatttgttttatggtatcatgtgttctatcaagttggctttagatagccacttctcttttcttctctctctgtaaagatacagatgtttctaccactaagagcagtcaagcaccactgtacattctgagtttgtggccttactaatcaatggcatgttttctggggtgggtgttccctttctagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaaca

SEQ ID NO: 9531 - DNA, 3379 bp, Homo sapiens
  ENST00000216281
gtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggcctta

SEQ ID NO: 9532 - DNA, 3510 bp, Homo sapiens
  ENST00000334701
gggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagcagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacagagccaaggtgcagggcaacacctctacaaggatctgcagccatttatattgcttaggctactgatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaag

SEQ ID NO: 9533 - DNA, 1710 bp, Homo sapiens
  ENST00000554401
ggttgagacgttcgcctttcaggcagaaattgcccagttgatgtcattgatcatcaatactttctactcgaacaaagagatctttctgagagagctcatttcaaattcatcagatgtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgttgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcc

SEQ ID NO: 9534 - DNA, 694 bp, Homo sapiens
  ENST00000557089
atctctactaaattacaaaaattagccccatgtagtggcaggctgaggcatgaaaacagcttgaacccccccgggaggcagaggttgcagtgagtggagattgcgccactgccctccagcctgggcaacagagtgagactgtctcaaaaatacgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaatcttgtaggctctgtgggtgtgttttctactcaggtagcactgttacaactggtattgatc

SEQ ID NO: 9535 - DNA, 488 bp, Homo sapiens
  ENST00000560130
agagctcaacaaaacaaagcccatctggaccagaaatcccgacgatattactaatgaggagtacggagaattctataagagcttgaccaatgactgggaagatcacttggcagtgaaggtgagtgactgatgggtgcttcaagcttgtccttagattatcatctttctccaccaccccaaatatcttctataatgcattgttcattggtacttagtgtatctgttttattacagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttat

SEQ ID NO: 9536 - DNA, 581 bp, Homo sapiens
  ENST00000553585
agttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaa

SEQ ID NO: 9537 - DNA, 429 bp, Homo sapiens
  ENST00000555662
ctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgata

SEQ ID NO: 9538 - DNA, 552 bp, Homo sapiens
  ENST00000556554
agttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagtt

SEQ ID NO: 9539 - DNA, 584 bp, Homo sapiens
  ENST00000557234
gcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgca

SEQ ID NO: 9540 - DNA, 595 bp, Homo sapiens
  ENST00000558600
aggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacag

SEQ ID NO: 9541 - DNA, 2572 bp, Homo sapiens
  ENST00000371646
ggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagtt

SEQ ID NO: 9542 - DNA, 2582 bp, Homo sapiens
  ENST00000353801
ggcacgcagtagctctctcgagtcactccggcgcagtgttgggactgtctgggtatcggaaagcaagcctacgttgctcactattacgtataatccttttcttttcaagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 9543 - DNA, 2674 bp, Homo sapiens
  ENST00000371554
gtgcccggatgctggggcgagggagggtgcactgcggcgccccctcctcgcgtggtcctggccgacgcatgtccggcagtgacgagtgtcggcctggtggctacggccaccatctttcttgggtttggtcctgttctgtaattttgtgctgtgaaagggtcgtggtggagcttttggcttaagaattctttgtccggatttaattgctcctccgatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 9544 - DNA, 2644 bp, Homo sapiens
  ENST00000620073
agaggggggtcccccccgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagttct

SEQ ID NO: 9545 - DNA, 2483 bp, Homo sapiens
  ENST00000433487
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9546 - DNA, 1909 bp, Homo sapiens
  ENST00000452298
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9547 - DNA, 2483 bp, Homo sapiens
  ENST00000400040
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9548 - DNA, 1909 bp, Homo sapiens
  ENST00000383389
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9549 - DNA, 2483 bp, Homo sapiens
  ENST00000430065
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9550 - DNA, 1909 bp, Homo sapiens
  ENST00000422919
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9551 - DNA, 2483 bp, Homo sapiens
  ENST00000375651
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9552 - DNA, 1909 bp, Homo sapiens; identical to SEQ ID NO: 9546
  ENST00000608703

SEQ ID NO: 9553 - DNA, 2483 bp, Homo sapiens
  ENST00000441618
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 9554 - DNA, 1909 bp, Homo sapiens; identical to SEQ ID NO: 9548
  ENST00000449876

SEQ ID NO: 9555 - DNA, 2521 bp, Homo sapiens
  ENST00000445736
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttt

SEQ ID NO: 9556 - DNA, 2521 bp, Homo sapiens
  ENST00000375650
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttt

SEQ ID NO: 9557 - DNA, 2525 bp, Homo sapiens
  ENST00000391555
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttttttttttttttttttttttttttttttgcttggcgaaaacactacaaaggctgggaatgtatgtttttataatttgtttatttaaatatgaaaaataaaatgttaaactttt

SEQ ID NO: 9558 - DNA, 2348 bp, Homo sapiens
  ENST00000458062
ccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttttttttttttttttttttttttttttttgcttggcgaaaacactacaaaggctgggaatgtatgtttttataatttgtttatttaaatatgaaaaataaaatgttaaacttt

SEQ ID NO: 9559 - DNA, 2515 bp, Homo sapiens
  ENST00000450744
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgttttttttttttttttttttttgcttggcgaaaacactacaaaggctgggaatgtatgtttttataatttgtttatttaaatatgaaaaataaaatgttaaactttt

SEQ ID NO: 9560 - DNA, 1929 bp, Homo sapiens
  ENST00000417199
ggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattag

SEQ ID NO: 9561 - DNA, 2524 bp, Homo sapiens
  ENST00000391548
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaactttt

SEQ ID NO: 9562 - DNA, 2347 bp, Homo sapiens
  ENST00000545241
ccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaacttt

SEQ ID NO: 9563 - DNA, 4825 bp, Homo sapiens
  ENST00000304858
ctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaaaaaattttttttttttttttttttttttttttttttttttttggtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttgaa

SEQ ID NO: 9564 - DNA, 552 bp, Homo sapiens
  ENST00000504328
ataaggatgtcatcacttatttagcctaacttctattactgaatctaattagatctagtttgcttctaatctgttagagatttgaaaacgggtaacccaggctaattagacttccaggttaaatagaaacacattgcggttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggt

SEQ ID NO: 9565 - DNA, 690 bp, Homo sapiens
  ENST00000514825
tcccctcctgaagtagcttcatatttccaaaggcctggagaaatatatttaacttcttatatatagcacacggagattaaatgtactttatcactagttttagtggaatcagtactctggatcgttgaactgccgtatgaagactgtgtattcttctgttaagaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagct

SEQ ID NO: 9566 - DNA, 2204 bp, Homo sapiens
  ENST00000615899
agccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcgttcttttgtctctcgtatgtccctagctcagttttcagttcagaaagtcctcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggt

SEQ ID NO: 9567 - DNA, 2358 bp, Homo sapiens
  ENST00000617074
caccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagaaggcaaaagtgaagaccagtactgtggacctgccaatcgagaatcagctatttggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataaca

SEQ ID NO: 9568 - DNA, 3020 bp, Homo sapiens
  ENST00000508776
atgggcccctcggggaggcgaggcctgcgggcgagcccttctgagggcagggggtgagggggcggcgcccgccagccaggacagcatcctgccgccgtgacaagcacgcctccggttgccaaaacaacccaaaaatgtgcctcaaaacacgttcgcaaagccccgggccggccggtcgcctgcctctcacctagcccgaccgcccgacgtcctactgccgagcgagggcgagcaagccaatgagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcattt

SEQ ID NO: 9569 - DNA, 10790 bp, Homo sapiens
  ENST00000296464
ttttccagatctttctcgaacccgcagcttcttgggcagccgttgcccgagtgctgacggaagcggccgaagtccgggcccggagctggctcgggcgcggagcggaggctcgcgcgcctcccgggcagccgagcgcgcaggcgcaggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggactttagagcttctatttgggttaaaacatccactcacttggttaggagctatgcctcagaaacttcctgggagtaaatatgggaacaacttttctattaatacatctaaattttctagtatatcctgacattttccattcctgctctgaagtcacttttagttttgtgttttagtcagatagtaccactaatttttgtaattatataacacttcatttaataacttatatacatccaaatatatatactttttctacccaattattcaacttaaaagatttcaaaaacgatttagccttataatgtatttatttatttaattcattaatgaaagagagtgctctctttaatgcagctttgggtagacagtctaattcagtccaattttaatctgcattaaaatatgcaatgctagacaaagattttcaaaataaaaagctattatttcagaaattattttaaaagatgcatagtaaaacagtgttttcctatggtaagcaaataagaatgaagtttgtagggaatatttggaatgattaatataaattagtatactttggctctgtggaaaagtgtaaattgtggttttagaaaccaactcttgatagttgtactgtgattataaaaaacaattgttaaataatataatggaagtttgtgataattccttagcagtaatgtaaaattattaagttttggccaggcgctgtggctcacgcctgtaatcctagcactttgggaggccaaggcaggcagatcacctgaggtcaggagttcaagaccagcctggccaacatggtgaaaccctgtctctactaaaaatacaaaaaagtagccgggcgtggtggcatgtccctgtaatctcagctacccgggaggctcaggcaggagaatcgctggaacccaggaggcagaggctgccgttagctgagatcgtgctcctgcactccagcctgggcaacagaacaagactccgtctcaaaaaaaaaacaaaaattcttccaaaaaactagaaagagcacagcaaagaatttggctattgaaataacagataaacttgattttgaaaaggataacaaggctgggcacagtgactcacacctgtaatcctagcactttgagaggctaagaagggaggatcacttgaacccaggagttcaagaccagcctgagaaacatagtgagaccctgtctctaaaaaaataaaaacttagcaaggcatggtggtgcacacctgtagtcctagctactcaggaggctgaggtggaggatcacttaagcctgagaggtcaaggttgcaatgagccataatcataccactgcactccagcctgggcaacagagtgaggccctgtctcaaacacataaaaggcagtggcccacgcctgtaatcccagcactttgggaggccaaggcgggcagatcacgaggtcaggagatcaagaccatcctggctaacacggtgaaaccccgtctctactaaaaatacaaaaaattagctgggcatggtggcgggcgccggtagtcccagctactcaggaggctgaggcaggagaatggtgtgaacccaggaggcggaggttgcagtgagccgagatcgcgccactgcactccagcctgggcaacagagcaagactccatctcaaaaacaaaacaaaacaaaaacataaaaggaaaacaagacatttactaagaagagctaaaggaaagaattaaaggtttcttatgcttttttgggggggggtgtcaatttttagtatattaagagctaaaagaagtaaaggtttcttagactttttttgggagggaggcgtcaatttttagtatatttgtgattaattccatgatagaagtctttaaagagaattttggggctcaataatttaacataatgtcagtgttaaagcacttaatccaaattagcccatctttaactgttttgaaaaatctatatttattaaaggtagtagacatttgaatatagtaatcaaattaactgattttgttttcaccctaaatacatacaaccattcctccactttcataaatttgacaaataataagcctctcccattaggattttctgttttatagtaaatagttggtatttggtagtccacaattaaagtcattgcattaattttacaaattatagatttagaaatgattcttaagttattggtaaaatataactttctcagtttttaaaagtttacaaaatttttttttttgttttgagacagagtatggctttgttacccaggctggattgcaatggggtgatctaggctcactgcagcctccaccacctgagttcaagcgatttttctgcctcaacctctcctgagtagctgggactacaggtgcatgacaccacacccagctaatttttgtatttttatagagatggagttttgccatgttggccagcctggtcttgaactcttgaactcctgacctcaggtaatccacccacctcagactcccaaagtgctgggattacaggcgtgagccaccatacccggccaaaaatttttgcttttaaagttaatgttattttgtggttaaacttctaaagttttgaactgtaagcagaattttgttttgtgatattttattgtataaactgttaatgagaggcacagctaattgtacatatcaatatacatttaaaatctggtaacactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgttttttttttggaaacagtctcactctgtcacccaggctggagggcacaatctctgctcactgcaacctccacctcctgggctcaagcctcaagcaattctcctgcctcagcctcccaagtagctgggattacaggaacccaccaccacgcccagctaatttttgtatttttagtagatggggtttcatcatgttggccaggctggttttgaactcctgacttcaaatgatccacccacatccacctgccagagtgctgagattacaggcgtgagccaccgcacctggccaatgttcttttatatactcatgttttctaacaaaacagctttggatttataatgctgccagatgtcattacaattttttttctaaattcaaaggtaattattctaaacaataaaagggcacctggaattttcagaacattaaaaaactgaaaccacttagaagaaaagaagaaacctaaatgtctgtggaagtgatcagtattaagtgggtgatggctctttcatcttccttatccctaaagatacttccaacatattgttagagtaagtattaaaagaaaaagtaggtttgctgaaaaacattactaaatgacttggagctctccagtcaaagaaacaaagctaattgaaataatgtacatttggttcagtctgtcaggcaagtacaaatccataacaaaaaaaattaatagtatgctctttgctttggaatctctaatttacggtcatgccctaagtcacaggatgattattagggaaatgtcattgacacctgaaaattacctatcctgtaaaaagactggtgaaattcaacatgttttaaataatttaattgcattatagcatataaactataaatgaaaatgatctttgtctttcctttatcttgctttatcctcttatccaattctagactcttaaataatcactgtatttttctcaagtatttgttattttttattatcctttagatctttttgttcatggctctttaaaaatagttttactgataatccaatcacttggatagttaattttattactttttgtttcctttttaatatttattcttcccgttaagggttttttggctataaattcgtacttgataagctatgttatttctttgtgtaatttaatagtagcattctggagtagattctttttttgtattctggccttggaatactttaattccggaccaaaagaggtcaattttgtgagtattgcctattaagtaaacaacatccctcatttttaatccaaatatcaatttgacagaataacaagggtcagaaattcaaaatagctgttagacacctttgattctttgctgctctctggttatgtatgtgtgttgtgcatcttccttgttgttttagagtttcctaaattttttgcttctggggacttgagtatttttaaatgttcttaaaattatatgaatctacccagaatgtagatgtcaaaatgtaattagaggccccgtgcagtggctcacgcctgtaatcccagcactttgggaggccgaggcaggtggatcgcctgagctcaggagttcaagaccagcctgggcaacatggcaaaaccccgtctctactaaaaatacaaaaaattagctgggtgtggtggtgtgtgcctgtagtcccagctactcgggaggctgaggcaggagaatcgcttgaaccctggcgaaaccccatttctaaaatagaaaaatttagccgggtgtggtggtgtgtgcctatagtcccagctattcgggaggctgaggcaagagaattgcttgaacccgggaggtggaggtcgcagtgagctgagatcctgccactgcactccaacctgggggtaacagagcgagactctgtctcaaaaaaaaaaaaaagtgtaattagaaatggaaatctaggtaaaggaagctttaaaatgttgtattttttccctgaaataaacttttatgatttaatgtcttggaaaaagactcacatgaaaagtggcttttatatttggtaggataaagccattgtcctttaataccatagcaaatagaagcaatttttaatgaggttactgaattgtttagtattcctaatatggcatccaggtcatcttttcttttctccaaccattattaaaataacttgacactttgggaggccaagctgggcagatcacctgaggtcaggagtttgagaccagcctggccaacatggtgaaaccccatctctactaaaaaaaatacaaaaattagcggggccatggtgacgtgcacctgtaatcccagctactcgggaggctgaggtgggagaatagcttgaacctgggaggcagaggttgtggtgagccaagatcacgccactgcactccagcctgggtgacagagcaagactccatctcaagaaaaaaataaataaataataatttgtgtatgtgatgactgactctagtcattatggaaaataacttttggcagtttagttcctaatgttaacaattcctctttttaagagaggtactacatttgatttctcaatttctcagtttgttttcaatacaaacagcaaccactgaaatgcagaaaatggtaatcaagtgtgatgtttctataaaaataattgagattcacatgtaatagaccctttagctttaatgagcagacatgagaatggtttatgatcttaagttggtaacataggaatatgtatttgtcaattttagttcacaaacatatccataagaatgtttacacatggcagtatcaaagcatataaaatattttctatgtaagtaaattgcatctttatgctagtgaacaaagtagcaataaatgttcatttttggatggcagtacacattgttaacaatcgtgtaattataataaatatgtctacctactccttgaaccatgaa

SEQ ID NO: 9570 - DNA, 1822 bp, Homo sapiens
  ENST00000508549
agtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaagattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacactt

SEQ ID NO: 9571 - DNA, 2639 bp, Homo sapiens
  ENST00000505726
aagtttgttggcaaggaatataatgaagtaattctgaaatatgaaaaactagttgctgcttataggctgctgttactggtaattttatgaggaaaccaactgtatgaaacctatattactttttatggaaagggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttc

SEQ ID NO: 9572 - DNA, 648 bp, Homo sapiens
  ENST00000515262
agttttgccatggtaacacttgtggggcattcctttttgaacagtacccgttcccttgatgtctacaatatcacctttcttatagattcgcatatacgtggccaaaggaataactccatgttttctaaaaggcctagagaacatatatcgggtgcctctcctctttccctttgtgttcgtcattttggcgaattactggaagatggcggttccagccgaaaggcgattttcttttattctattttaagacagtttctccctttttttaaggttgctttttgtttttattaataattactatgcatctttcttccaaattgatcagaattcaaccactagactttaaactacttcatttaaggactgtggctttttctttcaatctttccatgtatcattttgtaatcgctttcttatttgaattgaggaagaggaaatgtctttatttgttagtgaaggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgta

SEQ ID NO: 9573 - DNA, 2306 bp, Homo sapiens
  ENST00000532636
ggtttgcctggcgcgcggggaagtggagccagcgttttctttcacccagttccctgcttagtccagtcccaccgtggttcttcagagctgttcttggcgtgcttccagtatggggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 9574 - DNA, 1826 bp, Homo sapiens
  ENST00000533540
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 9575 - DNA, 2463 bp, Homo sapiens
  ENST00000534624
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 9576 - DNA, 2004 bp, Homo sapiens
  ENST00000453788
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 9577 - DNA, 2301 bp, Homo sapiens
  ENST00000532091
acaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcac

SEQ ID NO: 9578 - DNA, 2186 bp, Homo sapiens
  ENST00000227378
cagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggca

SEQ ID NO: 9579 - DNA, 1884 bp, Homo sapiens
  ENST00000534319
tacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggc

SEQ ID NO: 9580 - DNA, 1924 bp, Homo sapiens
  ENST00000526110
agcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccaca

SEQ ID NO: 9581 - DNA, 963 bp, Homo sapiens
  ENST00000524552
ctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccc

SEQ ID NO: 9582 - DNA, 740 bp, Homo sapiens
  ENST00000526686
actacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagct

SEQ ID NO: 9583 - DNA, 465 bp, Homo sapiens
  ENST00000533238
ggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcagaccttcactacctattctgacaaccagcctggtgtgcttattcaggtttatgaaggcgagcgtgccatgacaaaggataacaacc

SEQ ID NO: 9584 - DNA, 504 bp, Homo sapiens
  ENST00000526862
tctcagcgtcaggctaccaaagatgctggaactattgctggtctcaatgtacttagaattattaatgagccaactgctgctgctattgcttacggcttagacaaaaagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagt

SEQ ID NO: 9585 - DNA, 1509 bp, Homo sapiens
  ENST00000527983
agcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagac

SEQ ID NO: 9586 - DNA, 1112 bp, Homo sapiens
  ENST00000528292
gcctgcagctcttgggttttttgtggcttccttcgttattggagccaggcctacaccccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtg

SEQ ID NO: 9587 - DNA, 1194 bp, Homo sapiens
  ENST00000532780
ttccgtcttctcctgcccggctcccgcgcccaaacccctcccttcaggccccgcgcgattccgcccccagttctgtgccggccaagatcccggctagcgccgctatcattggttagttccaagtttgcccgcccctcttcctcctcctttttccgccccctccctcccgcggaagctgggggcgcatgcgtagaggtggacgctcccctcccccgcccggggtaactgaggactcccgcgcgcggactcgctgcgccccaccctccctttccccggggccgtccggagagcgggggcgagcttgaaagttccagaacgctgcgcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgt

SEQ ID NO: 9588 - DNA, 583 bp, Homo sapiens
  ENST00000525463
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcc

SEQ ID NO: 9589 - DNA, 570 bp, Homo sapiens
  ENST00000532167
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcac

SEQ ID NO: 9590 - DNA, 1048 bp, Homo sapiens
  ENST00000525624
accatttaaacctgtttattttataaacaacggggaaatgtagggcttgggctagttggggaaggactgagccaagaagccgaatctgttctagacggaggtgggaaggggcctaacggtcagggctcagagaagcggtttcgccttcttttccgcggagggatccagacacgaccgcgtcctgaggcggttctgaaaagccgggccccttaaacctctgcgtcgggggctgcctcccgacagttgccgtagggaaatgcaggtgctgggaggcctgccgagctaacccgccccaccccgcggcggcctggcggctccctccaatcccaatcctggggggccgtgagcgagcagccctagtggcaccctgaagccggaaccttcgccccagcccctcggggtcagcccttgtccaaagccacgctatgaaatacagattcgcgaaacccggggcacttagaggcccgtctggaacacgaagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaa

SEQ ID NO: 9591 - DNA, 588 bp, Homo sapiens
  ENST00000534567
agttctggacctcgcgcgtgcttagacaggagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacgg

SEQ ID NO: 9592 - DNA, 579 bp, Homo sapiens
  ENST00000527387
gctgcggtgagtgcgttatcgtgaggcggagcgcggtgggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgct

SEQ ID NO: 9593 - DNA, 674 bp, Homo sapiens
  ENST00000532182
gtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaat

SEQ ID NO: 9594 - DNA, 536 bp, Homo sapiens
  ENST00000524590
gtctgggagcgtgcagcctccacacaggcctgttgggcttgctgaggcttgggggttctgagaatctcgtcgaggcgagtgtgcggctccttctaccggcttaaagggcctcagttttcgcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaag

SEQ ID NO: 9595 - DNA, 648 bp, Homo sapiens
  ENST00000530391
gggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcgggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaag

SEQ ID NO: 9596 - DNA, 578 bp, Homo sapiens
  ENST00000531063
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaa

SEQ ID NO: 9597 - DNA, 3321 bp, Homo sapiens
  ENST00000297185
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 9598 - DNA, 275 bp, Homo sapiens
  ENST00000501917
acaggggttgatttgactaaagacaacatggcacttcagagggtacgggaagctgctgaaaaggctaaatgtgaactctcctcatctgtgcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttt

SEQ ID NO: 9599 - DNA, 1175 bp, Homo sapiens
  ENST00000524109
aggcacaggacgtgagcagcagattgtaatccagtcttctggtggattaagcaaagatgatattgaaaatatggttaaaaatgcagagaaatatgctgaagaagaccggcgaaagaaggtgattacttcttgtcttctgaactttaatcttagtaaagctcagtcttgacagtgggagtttggggctgggcgcagtgtctcactcctgtaatcccagcactgtaagcccactgccaaggtgggcagatcgtttgaagccgggcgtggtggtgcacgcctgcagtcccagctacttgggaggctcaggcaggagaatcgcttgaacaagaaagtgggagagtttggacatgtcataggttgtgggtaagagaaaacctaagataatctattcttccttccccgttgtttataccttatgtttgcagtgcctttattatttcttctgttttccctgtcacaattctgatgttacaaaatctagcccaaatctctctcaaagccatcccagactctttcatgccactctgatttctccctcttactctatttttatctgtaactgtatgtaacacatagcttattgtctgagtatagacattcagcaaactttggttgattggaaagtcttcgtttaaacttctaatttctctaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctat

SEQ ID NO: 9600 - DNA, 482 bp, Homo sapiens
  ENST00000512328
aacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggagga

SEQ ID NO: 9601 - DNA, 1796 bp, Homo sapiens
  ENST00000507097
agaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatacacactggttggtgactgagtcagttttttcttttttaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgttgtaatccagtcttctggtggattaagcaaagatgatattgaaaatatggttaaaaatgcagagaaatatgctgaagaagaccggcgaaagaaggtgattacttcttgtcttctgaactttaatcttagtaaagctcagtcttgacagtgggag

SEQ ID NO: 9602 - DNA, 780 bp, Homo sapiens
  ENST00000523929
ttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggaaatatgcaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttg

SEQ ID NO: 9603 - DNA, 582 bp, Homo sapiens
  ENST00000508003
actgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtg

SEQ ID NO: 9604 - DNA, 887 bp, Homo sapiens
  ENST00000504902
cgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagag

SEQ ID NO: 9605 - DNA, 663 bp, Homo sapiens
  ENST00000507115
ccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatacacactggttggtgactgagtcagttttttcttttttaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcag

SEQ ID NO: 9606 - DNA, 518 bp, Homo sapiens
  ENST00000505110
agaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccagatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtca

SEQ ID NO: 9607 - DNA, 584 bp, Homo sapiens
  ENST00000504810
ccgcgcgccctttagggtttgaattctccagtataggtcaggcgggaaggaaggtaacgggccttccatagttagcgctgccgggtcaagattttgcccaaggttttgcctccggcttgggccctgctgagtcacacccctcgcgatctagagtgtcatttcaaaattaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagt

SEQ ID NO: 9608 - DNA, 664 bp, Homo sapiens
  ENST00000506477
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacatgtgagtaacagcaaaagttttttgcaaaaagcagttatttgcaagggccacacagaagagcctcagcatgttgatgaggatccctggagcaccttactttagtaattttacttattgtccctaggggaaatctgtaccactgccaaaagggtaatcccttt

SEQ ID NO: 9609 - DNA, 551 bp, Homo sapiens
  ENST00000507886
atttcaaaattaccaggtagtggtcctcatggcctgttctgtggctgaatggaaaggtttggccttgggggtgagggatgcagtctattgggaaagccactattttcagttttatttttggctcctctacagaatacagagtgtgtaaggatcccgttgatacggtgaaataaaataagaaagctctgagtcggaactccagttttcgtgcttagcaacattttctcaaaatctgtggtgatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcct

SEQ ID NO: 9610 - DNA, 909 bp, Homo sapiens
  ENST00000248553
gctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 9611 - DNA, 1455 bp, Homo sapiens
  ENST00000447574
gacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttct

SEQ ID NO: 9612 - DNA, 527 bp, Homo sapiens
  ENST00000429938
agctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 9613 - DNA, 2455 bp, Homo sapiens
  ENST00000388968
agactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaataa

SEQ ID NO: 9614 - DNA, 860 bp, Homo sapiens
  ENST00000491249
aggcctgagtcaccacgcccggccaggccaacagtttattaagaaggtaaacggatatggacaagtataattaatagaaaatagcctaaactgtctcagatacttcctgtcttaatttgatcaaaaattgctaggaagcaaaaaaaaaacaaaaaaacacaaaaaccaaaccagattacttagggagtcctaagtaatctagtaacagcttgaggggaattaaacagataggcatttttatttcatttaaatcttactatcaactattcttaacaggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtg

SEQ ID NO: 9615 - DNA, 491 bp, Homo sapiens
  ENST00000482167
gaattagcctttgctgcatgaaatgaatccatcctaacttaaatgattattcaaataagcacttttgggattttttgcagaagtgtaattggatgtcctgggctgtttcatactctaccctgcatctcttatggccagaggggtctgtttttattaatctggcctgtaattccatgttttgtgttcaatgaaatccatatacctaattctttgacttttcataggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggtaa

SEQ ID NO: 9616 - DNA, 754 bp, Homo sapiens
  ENST00000430176
cggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagatggaaaaacactgaatgatgaattagaaattattgaaggcatgaagtttgatcgaggctatatttctccatactttattaatacatcaaaaggtaagaaca

SEQ ID NO: 9617 - DNA, 648 bp, Homo sapiens
  ENST00000486181
gacacaacttacgttgagactttgaagtagttgctttattatgaagactgctcatttttaaaaatgtaaatcatccttagggtatgtctgatcctgttacatttttttcttctagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtaagaa

SEQ ID NO: 9618 - DNA, 888 bp, Homo sapiens
  ENST00000452200
gaagactcggaggcggaagaaaaaaggagctgtttctaggcttttctaggcgcccagccgaggtgaaagaactaccccttcgtcccctcccggaaatgacgcgatttgacccttgagccgtagggagcgcggcattttctggaaagttctggaaccgagcgaggcccgggaactagactaagccggccggagagggctgagcgcgctagcacaccctgcgcggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcga

SEQ ID NO: 9619 - DNA, 619 bp, Homo sapiens
  ENST00000440114
gacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggcaagtgtgtttgtatt

SEQ ID NO: 9620 - DNA, 853 bp, Homo sapiens
  ENST00000476746
gggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggtaaggacttaacatgttacacgttttttaaaaaaaatttaatggcatgtgtgattttttttttcccttgatcacaccaatgtcagaataacaatactacccaatcatcaatattagaatcattgtttcttactgctaaaacctttgaaaagaattatgaccataatggttgtcatttagttctacatgtggttgtcattttagttctacatggctgtaaaatggattcatatgattgtgaaa

SEQ ID NO: 9621 - DNA, 714 bp, Homo sapiens
  ENST00000461097
gtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtaggaatgtctgttgtcaccacagtgttctaaacttcagtgtgctttaaggcattgattccttggacctaaggaaagtgttaacttgaggaaattaatccttctctcattcctcctcttggcctggagaaatcttaaactgggttttcctttagcaagcttggctgtatggtgggtaggtactgttaggtaattttgatattttacttagttggtttcttttgtttttagagacagggtcttgctctg

SEQ ID NO: 9622 - DNA, 529 bp, Homo sapiens
  ENST00000426480
agtgatgaaaacttgctggaccagagaacagctccagggaaagcggcagggagaggtggtcaaagggaaacaaggaggagaatatcggcacccggatccggctagacaagctggatggcaggaaacggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaa

SEQ ID NO: 9623 - DNA, 549 bp, Homo sapiens
  ENST00000428204
attgcggtgtgcgccctgcactctgtccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattgga

SEQ ID NO: 9624 - DNA, 578 bp, Homo sapiens
  ENST00000439605
actcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaa

SEQ ID NO: 9625 - DNA, 533 bp, Homo sapiens
  ENST00000418022
ccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcgaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagg

SEQ ID NO: 9626 - DNA, 2299 bp, Homo sapiens
  ENST00000345042
gccccgacgcgcaccgcgattcgccccaagggccctgcgcaggacgctgacgcgaagactcggaggcggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagtt

SEQ ID NO: 9627 - DNA, 890 bp, Homo sapiens
  ENST00000604458
tacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgt

SEQ ID NO: 9628 - DNA, 5191 bp, Homo sapiens
  ENST00000320027
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacgtacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgttta

SEQ ID NO: 9629 - DNA, 812 bp, Homo sapiens
  ENST00000435381
gatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatgattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaa

SEQ ID NO: 9630 - DNA, 3570 bp, Homo sapiens
  ENST00000630972
acacttctcccagcgggactacgattcccaacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaa

SEQ ID NO: 9631 - DNA, 3480 bp, Homo sapiens
  ENST00000380405
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 9632 - DNA, 3488 bp, Homo sapiens
  ENST00000602786
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 9633 - DNA, 4381 bp, Homo sapiens
  ENST00000626866
agtttaaaaaatttttttttatctactgaactgtagataggtgatcatttatcaaatattgctttaagcctgtactatttgaatgtgttaggctaggtattgtggatatacagaggtgattacagcatctctttcttgagcttttggtagtttattatgattacagatgaacaaaaaatcagttaaggaaaaaaatcagtttttatgctgaaaagttttactcatatttctgttaggtttttggaaaactgttaaatattggtaaaaatatgtttttaggtatacatgtttagaaatacagttgtttaaagttcagaaaaaaactttttaaggttgatcagctatttagctcagatctaaaaattggtaggaactatagttgctgtagttgtatattaaattcttaatttttttggataagcggtgtcctagcaggttgtggttaaaatgtaagtattgcataatgagtctgatactgtctgtgatacgtggttatgtttcactgtattcacgccatatgttttgtctagcacatctccatatattgaaaagtgatagagcattgttctgaaatcagaaagagagtaataattaattccaagaaaatcagtgtgaagtcaggtataaaaggaatgtaatgtgttcacctttaattgtttcaagttaatagtcaagcttcctgcatgtgtaattttatgtaacagtgagattcctaagaaaatgtgaaccaaagaattgaaacatacttattttttgtagttgctttgaattacggaatttataagcaggatctcccaagcctggatgagaaacctcggatagtggtttttgttgatatgggacattcagcttttcaagtgtctgcttgtgcttttaacaagggaaaattgaaggtaaagtcatacattggaactcagtgtccaaaacacgttaagtgttgtgactttaagctactgagcctctttactaggctttttcttcttggtaatgaagagttttattttaggtaaagatgttaacaggaaacggttgctaaggttgagctccataaagatgatgtaattgtcttagcatactcttaagtgttcttgtttaggaaagaaaaggctttttacagttattttctatgtagtcatttaaaagtcaaaaatatcttagagatttattcctgactgatttggatttcatgttataatttaaatatagtcttgagtctcttagtctttcattgtttgagtagtaatatttaagattctagttacaaatgtgattgaaaataaccagactatttgttgtttcaaccaaattaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagaggtaagtacttcaattaaatatttttattttgaaatatgtttagtttcttggccctgatatctatatttctagtagataaatggccataattctttctcatcccaagttttatatagttttagggataggatgaagacaaaactaacgaattttgcagtttaattttttttaacaaaaaaatctttctgcttgatataacatgattggctgagttcttgtgaaaaaattggatggcaataaatcataacagagcacagtacagttggaatttcacggcacactaaatatttctattagaatacattgtatttttttagtagtctgaaattctagaataatatgtgaaataattgagatttggtttttccatactgaggtgggaacatcgtatttaggagtttatttaacaataaactgtagtccatttatttatctttgatttaaaaatgtggcagagtggtgtgactgttatacattggccagtattaatctgaatatggataaccatttgtatacaagaaaacaaaattacatttaagcagtagcttgattttttttttttttttttagcattaaatatgaagtctgtgtaatcggttacaatgttaaaaaaatcaaacttcagcctgagtatttagaaaatggaaatgtctgtttggtttgtaggaagagtttgacaaggtataagttggaactgtgttaacactaaaatttgttttgtatcattttttttaaaccccagagtctacatatttagaatttagcttgagttaactagaagactggaattaacctttcctgtttcctgacagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatt

SEQ ID NO: 9634 - DNA, 333 bp, Homo sapiens
  ENST00000469538
gagaatacctctttgttttgttgtgaaaaattctgaagtacgagtgccactaatattgtcatattttgtgttaaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtct

SEQ ID NO: 9635 - DNA, 1034 bp, Homo sapiens
  ENST00000629751
agaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtaagtataattcagcaaggcagtgtgttttatttcatttttgcgttctttgtattacttttaagtatgaaatgtgggaaagctgttctttagttactagagaccgtgttctactggactgtattaacatgtgttccagagcattacaaagtagatttgagtgatatttttagccagaagcggcaaaggttcttgactggaaatcaaaatctcttgtgagactttttgaaaatacagattttgactggttccatttgtgagtattctaatacagttagttgctgcactatcaggcttgtacatttaacacaggagcttttcacaggtgaaagaattctaccctccgttgagaaaccagtgtattaggagttttaaaacgtagcttaccagtagtgacaaaacctaaatttttaacactagcaagcctgttaccttcagtggacaattactagttagactatcaaagggtacttgaaatggacaaaagtcatcttttatttggacaccaaaaaggtaaattctgctcacccaggtgtcttgggtcacttcttgataggttgtggggtatgcttttggacttaaatacagcatggtctttgctctatagtatgagcaacgtggccggctgagatcagtcagcaacaagcctttatg

SEQ ID NO: 9636 - DNA, 4987 bp, Homo sapiens
  ENST00000445273
acacttctcccagcgggactacgattcccaacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacgtacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcattttaaattgtcattttgtgacaatatttctaaacaacgtccatttttaataac

SEQ ID NO: 9637 - DNA, 2021 bp, Homo sapiens
  ENST00000369947
atttggtcaaagccttctcctcaagcagtacttcaccctcctgcactagacgcctccagggagctggagcggagcagggctcggtgggccagctcttagcaacccaggtctaagacccggtgtggagaggaacaaccacagacgcggcggcttagctaggcgctctggaagtgcaggggaggcgcccgcctgccttggctgccgcacccatgacctctagtttcagctgtgaacctgggcggaggaataattgaggaactcacggaactatcaactggggacaaacctgcgatcgccacggtccttccgccctctccttcgtccgctccatgcccaagagctgcgctccggagctggggcgaggagagccatggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcggtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaccaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttgacttgccgtttgcagtggggtcgcctaagcgacctttggggaccaagttgtgtctggttccacaggtaggtcgaatcttctttcgcggtttctgggtcccagcgaggctctctctcctgggcaagggcaatggatcctgagaagccagaatagtcctgagagagagctctgaaaggagaagtgttgaaactaaatgtagagcttccctgcccaggaggaggctcacttcctcccctcaagccccgggctcagcactgaccctgcggcagccaatcccaaagggggttgcaacttttaaaaattgataatggaagggaatccctgccctgctttggtatcgtggataatgcccactagaagcagtgtacttgtaattgttgtctgaagcctgtctgagacagatctacatacagcctggcagtacttgaactagacgcttaatgccctgtgtttttggggggagaactttgtgttacagc

SEQ ID NO: 9638 - DNA, 4835 bp, Homo sapiens
  ENST00000378688
ccagccccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactcaaaaa

SEQ ID NO: 9639 - DNA, 509 bp, Homo sapiens
  ENST00000612998
tttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatggtgagtggcattagtttcccagctatattcgcactggtaataaagagcatgtgcatgccaccagcagatgagatggggctcagggggcaaacaaactataaatagaagtctttgtttatagactagagcctactatgttacttatattttactcttaaaatgggatttcacataaaaatcagacagtcta

SEQ ID NO: 9640 - DNA, 4689 bp, Homo sapiens
  ENST00000543956
ctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtggaccctgaagacaaatggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactc

SEQ ID NO: 9641 - DNA, 5429 bp, Homo sapiens
  ENST00000542664
ctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtggaccctgaagacaaatgacatttatcttcccgagcgctcaaaaaaaaccctgcaacctctatgctaaaagttcattctgcttttttgtcctcggtttggtgagaaaataataaaaccaaacagtggactctcctaaaattgtgaatgaagaaaacttacagccaccacagttcagttctttaactatcattgtaataatggaagacaaaaatccagccccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctataaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttaaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactc

SEQ ID NO: 9642 - DNA, 3288 bp, Homo sapiens
  ENST00000371951
acccgcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactgtctgggaaaaaaagaataaaaagtagtgtgagagcagaaaacgtgattgaaacacgaccaatctttcttcagtgccaaagggtggaaaagaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaa

SEQ ID NO: 9643 - DNA, 4751 bp, Homo sapiens
  ENST00000276198
acccgcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 9644 - DNA, 4652 bp, Homo sapiens
  ENST00000371950
gcgcgaggtaggcgctctggtgcttgccgaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatctgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 9645 - DNA, 2912 bp, Homo sapiens
  ENST00000287907
agcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaagtcaaggcaaataagaaggaggaggtaaaacaatatgggcaggttgagattgaatagaaaagaatgaacaagtcatgatgtagacctctgagggtaggagaccatagttccaggctttctggcacagtccccatttcaaatattctctgtggtcctagtacatatatcctaatactgatggggtatgacccaagagttgaccacaaaacactgtctccaaatatattaaagtatatagtcctatccatgagagcagggaatcttagctttaaggttttgtttgtggcaaccacacacgaacatacacacacacacacacacaactatgaaagaggcaggtgttctagctagctagtttactccaaaatgcaatccgttgacatgaaacaggcactgagggtaactacttcctttcattttgaagcaacagtttataaacaggaaagtctactggtttcatagaatctgtcagatttgtttatttgctactggtttcacgcgcgtggactatattccagtgtttctagtcaaagacctttatcctcaaatcatgagattagagtaaaacaactgctgtaaggttgagcatttcatgaccaatgactatgaaggcacattcaccaaacacaggcactttaagggcatccttgattaatttgctaattgctattttttgttggtatgtgaattcctgctaggaggccgaggctagtaggcaatgaaaaagacagaacaatggtaaaatgcagccccagtcctctacaaattgacagtataatttatgaggtgaggcagttaagtgatgatgcagcatttggatgatcatgtaaaaccagtgtcattacacaaaacttaaaaaaaaatcctaggcaataaaactgcctgtggtctgctatgtctctgactcttcaaatgcatgaattaaagaatgatataataatctctg

SEQ ID NO: 9646 - DNA, 558 bp, Homo sapiens
  ENST00000486819
atgcagtgtaggcattctcacgtcagatcaggtataatctcatcatgaacaagggctgcagcacattttatttggaagcagatcctacttattgcaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatctt

SEQ ID NO: 9647 - DNA, 2703 bp, Homo sapiens
  ENST00000395731
acacgaagagcaccacacagagcggcaggtagaaggcgcctacggtggagaacacggcgtaggaaggctcgcggcttacctggcactcctcgctgccctcagagtacgtctctccccagccaaaaagcagcggggccagagagatgacagcggagagtgcccaggtgagcgcgatcatgacgttggagacgcacttgcgggtgcggagcgtgtattccatgtggcgcgtgatggaccagtagcggtccagggctatggccgtcacgttccagatgctggccgtgcagcaaagcacgtcgcacgcgatccaaagctggcacagcctccgacctagctgccagcggcgcccggacagctcgtgcaccaggctcagcggcatgaccagcgcggccaccaggacatccgagacggccatggatgccaccaggttgtggggcacgcggtggaaggtgcgtacacggaggatggtcgccagcaccagcaggttccaggcgaacgtcgccgccaccagaaagcccagcaagagtaaaacaagtatcaggagaatgcactgagaaaagagaaagtcctccactggaacctagaggacgggacaacatcattaaataccggattattcacagggctgtttcaaacaccacttaaaaacagctgatggtgactgcctgcatgcagagcaactgtgcatggccccaatctggaagcaagcttgtgcttctttaaggcaaatcaccttcttgaggtcatggaactaatgggaatgagatgtaaactatgaatcctcttctttggaaaaagttctgcatctagtctcagggcctgttatctggaggaatggatgaactgtgttgcccacaggcgggcctcaatggatctctatgaatcttgaaaggcattatgggcttgtgattatattccctactgattccccaggccacagctgtctgtattgatagctaagtgagcagcagaatagttaataaggacaaagccaaggatgactgaggataatttgtgaaaaatagagtgtcataaatttagggactgaatagaatattcccacaaaggagagatccaatggagcatttccagaagggacaaaccctgttcagaaagtctggcttatctcttaaaaatacacaaataaaaaatcataatatttcagcttcatcttaaagcatagccccaattttatcttgaaaaacactgaaaaggaaaagaatctgaaaaggtataaaactcccgtctgccatatggtacctctgaaatggcagtattgggaaatataccttcctgggttgtcacctcttatgggttaaactgtgtctctccttcccccctcccttaccccctgccagatttatatatggaagtcctaacccctagaacctcatagtgtgactatatttagaaataagatctttaaagggatgattaagttaaaatgaggccataggatagggcctcattcaatctgactgacatccttatgaaaagaggaaatttagacatgcaaagagacaccaaggatgtgtgtgtgcataggatagaccacgtgagaataaagcaagaaggtggccatctacaagccaaggagagagacattagaagataccagtattggaagattagaagatatcaagattggatttccagctgccagaactaggaaaaaataaatttctagtatgagccactcagtctgtggtattttgttatggcagccctagcaagctaatataccatccgacaaaagatactagcaaaagatacaaccacataactgaacgaggtgctatactggagaagagggaattatagacatataaacaaatcatgggacatctactaaaacctttccaaaaggtagtttgcagccatctagcaatcattcgagtgcagactcagttgtctattgaggttacttacggtttgtaatcaagtcatgtcactggcttatagaaaaatacttattttagatttttctataatgggaaggtatgaatctatttcattcaagtaggagctgattttttggtttgtttttgcttctgttttttgagacagagtctcactctgtcatccaggctggagtgcagtggcacaatcttggctcactgcaacttccatcttccgggttcaagcgattcccagctaagttttttgtatttgtagtagagatggggattttaccatgttgtccaggctggtctcgaactcctgacctcaattgatccatccccatcagcctcccaaattgttggaattacaggcctaagccaccacacccggccaagaccaacgaattttaatgtaacagcataataaacatgcatgatacaatttcagattccacatcacaacaaatctttaaggtgctaccactcattgagttttaatatagcatcacagaaaaaatatccataattatctgaaaatagtattaaagtactctattgtctgctgtatatctgtatgaaagtggatgttcttcacaatcttaaactaaaataacatatcccaacagatggaatgtagaaacatatgatgttctagctgtcttgaagagatttgcaaaaatgttaatgctattcagaaatattttatgaaaaataattatttttcataatgaggtatcacttatatagacatgtaatgggtttattttatttttaataaacaaatacacaaatatgttgaaaa

SEQ ID NO: 9648 - DNA, 551 bp, Homo sapiens
  ENST00000493904
acacgaagagcaccacacagagcggcaggtagaaggcgcctacggtggagaacacggcgtaggaaggctcgcggcttacctggcactcctcgctgccctcagagtacgtctctccccagccaaaaagcagcggggccagagagatgacagcggagagtgcccaggtgagcgcgatcatgacgttggagacgcacttgcgggtgcggagcgtgtattccatgtggcgcgtgatggaccagtagcggtccagggctatggccgtcacgttccagatgctggccgtgcagcaaagcacgtcgcacgcgatccaaagctggcacagcctccgacctagctgccagcggcgcccggacagctcgtgcaccaggctcagcggcatgaccagcgcggccaccaggacatccgagacggccatggatgccaccaggttgtggggcacgcggtggaaggtgcgtacacggaggatggtcgccagcaccagcaggttccaggcgaacgtcgccgccaccagaaagcccagcaaggcagccggctgcagccttaactccgtg

SEQ ID NO: 9649 - DNA, 2120 bp, Homo sapiens
  ENST00000368984
caatgggctgggccgcgcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgc

SEQ ID NO: 9650 - DNA, 1214 bp, Homo sapiens
  ENST00000420892
ggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 9651 - DNA, 7385 bp, Homo sapiens
  ENST00000270112
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagaggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtctgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactacgactgcttctttatttgctgataaatcttaaaacaactaagtacgttgcaaataatagtacaggtaccatcttttatgtgaagttctttttctttttttgagacagggtcttgctctgtcacccaggctggagtgcagtggcacaatcacagttcactgcagcctcaacctctccagattcaagtgatcctcccatctcagcctcccaagtagctgggactacagttgtgcaccacaatgcctagctaattttttttgtattttgtagaaatggggtttcgccatgttgctcaggctgatctcaaactcctgggctccaacgatctgcccaccttggcctcccaaagtgctgagattacaggcgtgagccactgtgcctggccttatgtaaagctcttgacctagcatctgactggaaacaagcgggaattgcattggggggcattttctgggccagtttccctgccttattttacctgcaataggtgtgcctacaaaagtctttctgacatacacactgcaggtggcagttcaagaagaatcaacctttttcatttggggatattaggatcttccttggagactctgaaaatggcacacaaagaatggcagttatgaacgtgacttctagattttgtccttgtaggaggccttggtcatggataggggaagagggatgatgggatggaatgggagggtgggatctagatgacctcttgaaattgtcccagttactgcttccttcataactgttcacaaaacgtttttcatatataccaccttgtttcccctgggaagtgaggggacgaagccttagagggtgacatagctagaaagtggagaagctcactgttcactgtgcaaagccccagtagtcggattccggggaaaagaacaagtatctagttttgatgacaatgttttcttgtaagaatcccaacactttagaatagaaaaggacctaagattctctggctcagccccagcctttctgaagaagggaaaactagggacccagatggtttaaggacaccccagagtccccagatgagctggcatttgagctggtctggagcagagtttctccctcaaagaacacagagaaatcagagagtggctgccatggtcagagggggatgtcaacaacagatcaagccgtcatcacaacaggtatttctgaagttcctgcagggactaggtcttgcatttttaagtccttttcaaaactgtgcagcttcctgaaccttatgctgtttgtcccatccactcttgaagctggggaaagacagctttctttgggaactctgtctttctcagttgacttcccaagtaagcagcaaacccctggatagccttgttatctactttaggtattaagaggctattgggttttactagattaaatcaataaaacatttcctatagagccatatcatacactgaagcaaattcagaaagaatgcaaaactgctatcttttgggggagtctggaagcctgttggttagtgtatttattttctttgtggggtcttctgtgagctacaggcacagtaagaataattcagagcggtactgggagttggttcaatttcatgtcatcacttttcaatgaagggagtgcatttcctgagtagtaaatgagtatattatttgtggcagcttttctgttaagggagctttccagacatctggttgcaaagacaaataggatatatatttgtacttcttctctgtggacatgtttttgtgacacacagttatctctaggagttgacgtctgtgggcactaagggactgaggttgggggagaaagctgaggaggctttggaagagaaggtgaggagcatttcaggatttgcagtccccctccacatgtatccacatctgagctggtggtgttccaataatgaggcatttggggcaaccaattttggaaggatagaatagctttatgtggagcaaacttgaggatcaattggagttgagtggtttaaaacttaaagatggcacaggaagctgtatcatttacaggtgaaaaaaataaatgggtctgacttca

SEQ ID NO: 9652 - DNA, 486 bp, Homo sapiens
  ENST00000430354
cagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccatgtgccatcagtttcctgcgctctctcctggaaccggatcctgtgaagaggccaaatattcagcaggcactggcgaatcgctggct

SEQ ID NO: 9653 - DNA, 832 bp, Homo sapiens
  ENST00000465574
agatgctattaagtgattattaaaattttattgggtatgttgatggtattgcggttctgtgggggacatctttggtttttgaaggtgcacactcaagggttaaggggtaaaatgtcatgatgtttgtaatttaaaatacttcagcaaaaaaaaaatgcaaggatggcaaagtgatcactggtatatctagatgatggtatacataaagtgattgtactattccctccgcttttctgaatacgagaacattttcaaaataaaaactcaagtcagtgaatgaatgagtgaatgaatgaagctgattgtgcccagggggtctgtgtggggctctccgtgaagtgcaggggtgactggtcctctctctctgcacctcgcaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctcca

SEQ ID NO: 9654 - DNA, 860 bp, Homo sapiens
  ENST00000439107
cgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaaggactctcctgaggatggaggcccttgtcaccgggcatcttgaaaggacatcctgccattgttcacaggactcaactacagactgctcttccagatcttgaaataagtaccccctggcctggctcaggagcctgctaggacctgcacaagatggtgtgtggacacagcccaaggcttcccttccacgcggtgggaggccgaggagtgagaaagcggaattccgctgtgcaggggagctgaccgatgcaccccggggggacgccggccaagtgaatggggtcactccaaggccagggactctccacatcttccatggtgtgacctggatccccacacatgtggtgtcaatcaaaacattgctctagcccggggtgttactcccttcctggcccctgcgctttgtgtgcttgggccgcatgccccgcctccccactccacgaagtgtgagacagcaagacatgaacttgcttgatacctggtccccctgacacgcagctggagcacgcagcatccccacgtgtccagagactgcg

SEQ ID NO: 9655 - DNA, 3000 bp, Homo sapiens
  ENST00000221980
gtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaa

SEQ ID NO: 9656 - DNA, 928 bp, Homo sapiens
  ENST00000588912
agctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccgga

SEQ ID NO: 9657 - DNA, 567 bp, Homo sapiens
  ENST00000586004
gtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggagga

SEQ ID NO: 9658 - DNA, 624 bp, Homo sapiens
  ENST00000587398
tcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacct

SEQ ID NO: 9659 - DNA, 2599 bp, Homo sapiens
  ENST00000586480
ctcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaagg

SEQ ID NO: 9660 - DNA, 4771 bp, Homo sapiens
  ENST00000343813
cgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 9661 - DNA, 328 bp, Homo sapiens
  ENST00000495791
cttatttctagatttcatggcttaatgaattttttcattgttatatataccaaagaggcttacgggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtg

SEQ ID NO: 9662 - DNA, 2612 bp, Homo sapiens
  ENST00000489498
gccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtcacatctagtgcatccccacagccactgtaggatttttccctacactatgatttcagtcccttgagccttctagtctgacctggatatgaaccagtggcttcaaggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctaga

SEQ ID NO: 9663 - DNA, 1227 bp, Homo sapiens
  ENST00000474756
gccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctgaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttattt

SEQ ID NO: 9664 - DNA, 1009 bp, Homo sapiens
  ENST00000344330
ggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaa

SEQ ID NO: 9665 - DNA, 7080 bp, Homo sapiens
  ENST00000407780
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 9666 - DNA, 4246 bp, Homo sapiens
  ENST00000400379
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggtgagtttgccgtgggaagcagcaggttctggggggcccaggggaggcttggctgccagctgtctttcagagtttcaaaaaactttcaaaaggcaaaagtcccttgccttgaacaactgttgttcctggagacgcagcgaagccctcgatggtgcgcatggcatttcctgcagcctccccttggcatgggatggcatcctggtgtgcactttgtcacactgcgatgggattttcccaacatgcacagaagcagagagacgagtgctagacccccgcgctccccagtgcccagccccgaccagggtgtccagggcgggtccaggcaccggcgcccagcccccatggggtgtccggagtgggtccaggcaccggcgcccagcccccgtggggtgtccagggcgggtccaggcaccggcgcccagcccctgtggggtgtccggagtgggtccgggcaccgccagcttctctctgtggcagccactcctgcagctctcgtttgcccctcagttccaggagcaacatagatgtggattcctgtccaatttgggaaaaatgtccacacacggtcacccacctggcaggtgcctctggctgcaaggggcgctgggcttcgcaggcaggccagccgggctccccgccatgggccaggatcccctccgagccctgtttgccgcccaggagaaggggttccccggggacagtgggctcagggtgtgcgcagccaccatgctgtggtgtcacctgtggacccaggcgagctgatggccgaccgcagaaacgcacttccaaggccaggtcggcccatccagatgatgcaggaacacagcttgctaaaaacacggccggcctgttcccgtcggagccagtcgaagttccctgaacaggccgctgtttccgaagctttaaaccctgtgtttccaccaagctgagtcctgagaaaaccgacgtctgcctgcagaagggaaaggggtgcttcatgttcctctctctccttcatctcccttccaaggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 9667 - DNA, 2907 bp, Homo sapiens
  ENST00000400377
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 9668 - DNA, 2041 bp, Homo sapiens
  ENST00000234091
gcgcgctgagtgacggcgcggttgccatggcagccgcctgagcggcgccgcgaggacaaggctgcagggcggcgtgaatgggcggcgtcacgcgcctggcgccagagagtctgctccggggctccggctccggccccgccgcggcctggcccgcgcgccgccgccgccgccaccgccgccgccaattcatcacctgtcagggatcactcgcggggtcacgggcggaatggacacagctgtgagaacaaaacccgggaaagaaaggcgaacgctccccattgcgccagatgtgcagggaggaccttgagacgcgccccccgcccccgcaggctcctcccgccccccggcgcatcacgcgggggtggcaaaggcggcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagctgggctcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 9669 - DNA, 623 bp, Homo sapiens
  ENST00000331129
attctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttg

SEQ ID NO: 9670 - DNA, 474 bp, Homo sapiens
  ENST00000472142
aaaaaaaaccctttctacttaacattgtcttaacctcgtactctttatcctctttctttccaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgt

SEQ ID NO: 9671 - DNA, 1362 bp, Homo sapiens
  ENST00000396290
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtc

SEQ ID NO: 9672 - DNA, 2344 bp, Homo sapiens
  ENST00000378700
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgta

SEQ ID NO: 9673 - DNA, 2301 bp, Homo sapiens
  ENST00000381344
gggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaatgtttgttaaattcaatagaatgactcatttatggttaactttgggcaatttataatttcagacaagactgtttagcaagtattttattgaaaagtaaaaaaaattgcaatttaa

SEQ ID NO: 9674 - DNA, 1066 bp, Homo sapiens
  ENST00000491735
cgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgc

SEQ ID NO: 9675 - DNA, 441 bp, Homo sapiens
  ENST00000427898
tgcaagagggtgacagcaacacactcaaggcgcttctcctgggaatggagcaggagaagagatggggagcatcgcatagatggaactagacctttttcttgggttggatgatgtgttcccgcgtctactacatggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 9676 - DNA, 1017 bp, Homo sapiens
  ENST00000429642
tgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatgtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 9677 - DNA, 1029 bp, Homo sapiens
  ENST00000482091
gcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcatgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagca

SEQ ID NO: 9678 - DNA, 2571 bp, Homo sapiens
  ENST00000472558
ctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgag

SEQ ID NO: 9679 - DNA, 2843 bp, Homo sapiens
  ENST00000471408
gagcagttagtgagcagcttctggggtggaggctctgcagctggcgccggggcgctgggccgattcctcagcctctgaggcctcacctttggcgtggggaaataaacgcgtgcgctctgcaggagtattgtgagggtggtcatgtactcgggacagtgcccagcatgcagtgttagctggaagagtgttagctgttgcgattattatagtcctttctccactcttataattcccaggagtctctttctctctgggaatgtaagttctaggaggatgaggaccgctagtcgttccagtgagccccctgcatgtcccaggcactggccatgccctccagggcttccgtttggccagggagcagtggcccgagccgccccatgcccagcatattcacacagtgctgtggggaggccaccgctacccaggaagaggggtgcagtcagctcagggagactccacagaagaggcaccggtgcaatgtggtgggaaggatgaggaccttgccaggcctaattcgtccttgtctggagaactgggcgcctcctcactgttccctgggctccctggacagaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgag

SEQ ID NO: 9680 - DNA, 2850 bp, Homo sapiens
  ENST00000465801
gatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctggatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgag

SEQ ID NO: 9681 - DNA, 2686 bp, Homo sapiens
  ENST00000336604
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 9682 - DNA, 2786 bp, Homo sapiens
  ENST00000487279
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 9683 - DNA, 2677 bp, Homo sapiens
  ENST00000396840
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 9684 - DNA, 2680 bp, Homo sapiens
  ENST00000356896
cctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagta

SEQ ID NO: 9685 - DNA, 3001 bp, Homo sapiens
  ENST00000488007
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagaggtaacctctgctcccggcctcagggccctctggctctgcctctccagcctgaagcccactcccccgctcctctccttgctctgtccccccatgtggctgtcatcctctacctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacat

SEQ ID NO: 9686 - DNA, 1776 bp, Homo sapiens
  ENST00000396830
cccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcc

SEQ ID NO: 9687 - DNA, 2724 bp, Homo sapiens
  ENST00000619571
gccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctgtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgc

SEQ ID NO: 9688 - DNA, 3101 bp, Homo sapiens
  ENST00000436152
gatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctggatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagt

SEQ ID NO: 9689 - DNA, 2775 bp, Homo sapiens
  ENST00000615885
caccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagt

SEQ ID NO: 9690 - DNA, 4549 bp, Homo sapiens
  ENST00000327535
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatgctgctgctgcctttgcaaggactactgggcttcccaagaaactcaagagcctccgtacctcccctgggcggcggaggggcattgcacttccgggaagtccacctagcggctgtttgcctgtcgggctgagcaacaagatgcccctccctcctgtgacccgccctctttaggctgagctataagaggggtggacacagggtgggctgaggtcagaggttggtggggtgtcatcacccccattgtccctagggtgacaggccagggggaaaaattatccccggacaacatgaaacaggtgaggtcaggtcactgcggacatcaagggcggacaccaccaaggggccctctggaacttgagaccactggaggcacacctgctatacctcatgcctttcccagcagccactgaactcccccatcccagggctcagcctcctgattcatgggtcccctagttaggcccagataaaaatccagttggctgagggttttggatgggaagggaagggtggctgtcctcaaatcctggtctttggagtcatggcactgtacggttttagtgtcagacagaccggggttcaaatcccagctctgctgttcactggttgtatgatcttggggaagacatcttccttctctgcctcggcttcctcatctgcagctacgcctgggtgtggtgagggttctaggggatctcagatgtgtgtagcacggagcctgctgtgtcctgggtgctctctacgtggtggccggtagaattctccatctatccaggctccaggagacccctgggcatctcccacctgtggcccctaaacccagagtgactgagagcacttaacattcagcttgtctcatccccagtctacctccttccttctaccctcactgcctcccagtcaggagagtgagctctcagaagccagagccccacccaaggggaccctggtctctccgccttcacctagcaatgggaaccctgcttcccaggggaggaaccaactgctccaccttctagggacccagtttgttggagtaggacagtaacatggcaggaatcggacttctgggcctgtaatcccagtttggatggcacgttagactcttggttgaccgttgtggtccttagaagtcccattctcccttccagttatgagaaaccaatgccttctagattcaggtgactatccttacctgggggtgctgatgcatcctcagttaacctacacccacctgaatatagatgagcgtagctgagttttcacccgtaggaccgaagtgttttgtggtggagtatctgaacaaccttggctctgtggccattcaacctgccaggactaacatttctggatttgtgaagaagggatcttcaaagccattgaacccacagagctgtgttgctttaaagccaccacaagggtacagcattaaatggcagaactggaaaagcttcttagggcatctcatccagggattctcaaaccatgtcccccagaggccttgggctgcagttgcagggggcgccatggggctataggagcctcccactttcaccagagcagcctcactgtgccctgattcacacactgtggctttccacgtgaggttttgtttagagggatccactactcaagaaaaagttagcaaaccactccttttgttgcaaaggagctgaggtcaagggtggcaaaggcacttgtccaaggtcgcccagcagtgctgctctgatgacttgtgcacatccccaagggtaagagcttcgatctctgcacagccgggccaacctctgaccccttgtccatgtcagtaaaatatgaaggtcacagccaggatttctaagggtcaggaggccttcaccgctgctggggcacacacacacacatgcatacacacatacgacacacacctgtgtctccccaggggttttccctgcagtgaggcttgtccagatgattgagcccaggagaggaagaacaaacaaactacggagctggggagggctgtggcttggggccagctcccagggaaattcccagacctgtaccgatgttctctctggcaccagccgagctgcttcgtggaggtaacttcaaaaaagtaaaagctatcatcagcatcatcttagacttgtatgaaataaccactccgtttctattcttaaaccttaccatttttgttttgttttgtttttttgagtcggagttttgttctttttgcctaggctggagtgcagtggtacaatctcggctcactgcaacctccacctcccgggttcaagtgattctcctgcctcagcctcccaagtagctgggattacaggcacccgccaccacacctggctaatttttttgtatttttagtagagacggggtttcaccatgttggccaggctggtctcgaactcctgacctcaggtgatccgcccgcctcggcctcccaaagtgctgggattacaggcgtgagccaccgcgcccagccaaaccttactatttttttaaagaattttttccagagtttaatttctgacatagcttaagttttccagtaactctaaactccatctcctttatcgtcattaagtcattcacaaaaagccaggagaagcatttggaaagggcatgataatcagtataataatttgccttgtgtggtcagcacttaactgtttacaaagccctttcacgtgcacagcaggtgggaactgcgcggtgtgggctgggcctgcgctggaagcatatcccgtgaaaagtgttagtgccttaggtgaaagcaacatgtatccctttagactactaacggtatatgttgttcttatgtatttgtatttatttctattttttctatgtttatgtcatatttaaacgatatcctactgcttgttggtattaccctaaactgtttaaataaagagctctatttttaaagaaaaaaggtacaattga

SEQ ID NO: 9691 - DNA, 1476 bp, Homo sapiens
  ENST00000327575
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccaggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatg

SEQ ID NO: 9692 - DNA, 1476 bp, Homo sapiens
  ENST00000374421
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtga

SEQ ID NO: 9693 - DNA, 953 bp, Homo sapiens
  ENST00000374419
tcctcctaaagggccgcataatattgcgcgtcgtggcgtgtgccttactgggaagctactgctgtccaggtgaacaccacagccttcggggtcagaaagacagctttccccagaacaagcacctgaagctctggggcctgccgctccccgggagagaaggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggtatagcaaatctgggggtgtgcagcaggtggggaggggttgagagtaaggg

SEQ ID NO: 9694 - DNA, 674 bp, Homo sapiens
  ENST00000374418
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaaggtgggaagctcctttcctgcccccaggctaggcccgctcctccaccccttcttactcaggttcttctcaccctcccagcctgctcctgcacccctcctccaggaagtcttccctgtacactcctgacttctggcagtcagccctaataaaatctgatcaaagta

SEQ ID NO: 9695 - DNA, 574 bp, Homo sapiens
  ENST00000432734
agctgtaaatgggtcaggagaccagagtggacagagtaggccctggaatgcttgctcggaggcctgccatgaaggatttctgcttgcttccccaccctaccccgggggcaggatgactcagcacttcctattgttgtgaaggccaaccccaggaggccctaccaaggctgactgctgttaaaaccagactgcactccttctggctcctggttcattcaaggtctacatagttaaaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagc

SEQ ID NO: 9696 - DNA, 1834 bp, Homo sapiens
  ENST00000005558
gttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcag

SEQ ID NO: 9697 - DNA, 440 bp, Homo sapiens
  ENST00000443101
tagccaggggctgtcttcaatttcacagactatgtcatgaaactgtcatgttaaacatttatttttctagctgaatgtcatctttaagggatattatttcactggagaatttgctgagaggagactgacttggattttatcagtccaaaactgagccagaggaatctgctacaggcaatcaggagccagtgaggagttataagccaagcagtaacctgatgattcaatcaaaaaatatgtatggagtgtctcctacttttcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaa

SEQ ID NO: 9698 - DNA, 570 bp, Homo sapiens
  ENST00000445335
atagctgccagctggaagccgactctcgtcatagggcatactcgccccactgtgcatcgccggtgcctacctcacccagttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagtt

SEQ ID NO: 9699 - DNA, 429 bp, Homo sapiens
  ENST00000417662
agttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcgg

SEQ ID NO: 9700 - DNA, 2290 bp, Homo sapiens
  ENST00000403825
gctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaa

SEQ ID NO: 9701 - DNA, 1938 bp, Homo sapiens
  ENST00000429071
ccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaatgcccttatttttgagtcacagacgtacaactaataaggagtgtgttatcttcttttcagtaacatttagtaatagcactggaacactggcccactcttaaaattttctaatagtcaaggagtgcaccatcttgttatggctcaaaatgagacttgttagaactttgtttttgtattacgtaaaccaaaaaaaaatagcttgaaactaagaaggattagggtagattgtcatcaaccttttttgtatcagaagaggtgatggtcattctcttgttataccagaaaagcttgaaagtgtgtgtcagacatctagctcattttcccttgcacttatataaaacattgattgtacctgtaaattacatcattttcaggatatcccttggaatacttgaattctagaactttgtaatagaaattctggaattcaaattgttacagtgatagaacttttaagaccaaagagaaatcttaaagataattttatcagaccttaaagtccagtgttagtaggcttactagatttaggaaccaccaaatttaaaaagacttgtgactcggcatggtggttcacatctgtaattgtggcactttgggagaccgaggtgggaggattgctggaagccaggagttggagaccacctgggcaacaaagcgatacttggtttctattataacaaacaaaacaaaacgagatttggtgtctgccaacttattcagccaagtaagaacattatgaaaataattatcctccactatcattattttattagcaaaatattatagcaccaaaaatgtagaaatgcacttttaaaaaattgaatgaactaataagctttatatccttatttttctcattttacctgagagtaaaaattttgttgtaagtgaaacctttgatcaaattcactcttccattgaatagaataaagaaaggcctaggaaaactgaggtgggtctaagctgatatatcttgttattggtatagttgatagcagacccaactttttaaagataacacaatggcgctattaaaggtgttttacattcaaactatatgctataatggttgttggactagatgacctttaaaaattccattttagtttgcgtattttttacatttttaatttatcaggtaataatttaagctcagtatttgccccacacttgtggtgtatacagttctcaagagttaatttatatgtacctttatataaatgtattttttgtaccactgcattccagcttgggcgacagagtgagaccctgtctcaaaaaaaaaaaaaaataa

SEQ ID NO: 9702 - DNA, 486 bp, Homo sapiens
  ENST00000476927
gggtccttgggcctgagagtgtgtcgggacaggggctgaccgggagctgggcgggaaaggaaccattgtcagagttcctttctcggcggcgatctcgcccgatctctccccgaccacgggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtat

SEQ ID NO: 9703 - DNA, 891 bp, Homo sapiens
  ENST00000440625
tttgaatgctctccatgttgatgaaattcattctttatcaagatgtaaaatatgtaatttattgtggcctctggttgctctatgtgaattgaggatactttttttttttttgttaagggaaagagggagtctggctctgtcgcccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatt

SEQ ID NO: 9704 - DNA, 555 bp, Homo sapiens
  ENST00000466459
agaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgactttttttatgaagacatggagtccttgacgcagatgcttagggccttggcaacagatggaaataaacaccgggccaaagtggacaagagaaagcagcggtcagttttcagagatgtcctga

SEQ ID NO: 9705 - DNA, 567 bp, Homo sapiens
  ENST00000486688
agaccttaaagtccagtgttagtaggcttactagatttaggaaccaccaaatttaaaaagacttgtgactcggcatggtggttcacatctgtaattgtggcactttgggagaccgaggtgggaggattgctggaagccaggagttggagaccacctgggcaacaaagcgatacttggtttctattataacaaacaaaacaaaacgagatttggtgtctgccaacttattcagccaagtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgc

SEQ ID NO: 9706 - DNA, 1034 bp, Homo sapiens
  ENST00000421296
attgtaatgtgttttaaaggctttttgatagagggtaggcttctttagctcatatgtctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttatggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatttttttttttagtgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccat

SEQ ID NO: 9707 - DNA, 1721 bp, Homo sapiens
  ENST00000489994
catagccacgttaactgtgacaaggaagcccataatctgcttaaggtcacagcaaatttcaatacattttgcagctgtcccccaaaagggattaaaacttgttcttaccttaaataatttaatcacctgaattatgtgctttattgcttatttgaaatatggcagtaaattagaaagtagatgctttaattgtagctttatgcctttgggataagaataattggaagtctgtgaatgtttggtttggggactggggagccaagggtagaagctatattggtatatctgtctctcactgaactttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaataataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccaca

SEQ ID NO: 9708 - DNA, 664 bp, Homo sapiens
  ENST00000470441
ctttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaataataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaagg

SEQ ID NO: 9709 - DNA, 437 bp, Homo sapiens
  ENST00000462155
gttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggttctctggtttgtctggagtgtttgcaagtcagtcatcatagtggcagcttccgcctgctacaggatatttatatatggaagcataccatggcaggagtgctggaaaggtggtgtcagctaacagttgcttcagccagataaggacggtaacttcagtccaataaaaacctcatcagttacc

SEQ ID NO: 9710 - DNA, 3232 bp, Homo sapiens
  ENST00000621379
gttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagaccctgtctctaccagaaatttaaaaaatgagtgtggtggtgtgtgcttctactctttatctacttgggtgctgaggcaagagggtaacttgagcccaggaggtcaaagctgcagtgagccgtgattgtgccactccagcctgggtgacgagtgagaccttgtctcaaaagcaaaacaaaaaagaatattgctgcttgtttgcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaacaactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaac

SEQ ID NO: 9711 - DNA, 3397 bp, Homo sapiens
  ENST00000535603
tttgaatgctctccatgttgatgaaattcattctttatcaagatgtaaaatatgtaatttattgtggcctctggttgctctatgtgaattgaggatactttttttttttttgttaagggaaagagggagtctggctctgtcgcccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagaccctgtctctaccagaaatttaaaaaatgagtgtggtggtgtgtgcttctactctttatctacttgggtgctgaggcaagagggtaacttgagcccaggaggtcaaagctgcagtgagccgtgattgtgccactccagcctgggtgacgagtgagaccttgtctcaaaagcaaaacaaaaaagaatattgctgcttgtttgcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaacaactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaac

SEQ ID NO: 9712 - DNA, 574 bp, Homo sapiens; identical to SEQ ID NO: 9695
  ENST00000432734

SEQ ID NO: 9713 - DNA, 1834 bp, Homo sapiens; identical to SEQ ID NO: 9696
  ENST00000005558

SEQ ID NO: 9714 - DNA, 440 bp, Homo sapiens; identical to SEQ ID NO: 9697
  ENST00000443101

SEQ ID NO: 9715 - DNA, 570 bp, Homo sapiens; identical to SEQ ID NO: 9698
  ENST00000445335

SEQ ID NO: 9716 - DNA, 429 bp, Homo sapiens; identical to SEQ ID NO: 9699
  ENST00000417662

SEQ ID NO: 9717 - DNA, 2290 bp, Homo sapiens; identical to SEQ ID NO: 9700
  ENST00000403825

SEQ ID NO: 9718 - DNA, 1938 bp, Homo sapiens; identical to SEQ ID NO: 9701
  ENST00000429071

SEQ ID NO: 9719 - DNA, 486 bp, Homo sapiens; identical to SEQ ID NO: 9702
  ENST00000476927

SEQ ID NO: 9720 - DNA, 891 bp, Homo sapiens; identical to SEQ ID NO: 9703
  ENST00000440625

SEQ ID NO: 9721 - DNA, 555 bp, Homo sapiens; identical to SEQ ID NO: 9704
  ENST00000466459

SEQ ID NO: 9722 - DNA, 567 bp, Homo sapiens; identical to SEQ ID NO: 9705
  ENST00000486688

SEQ ID NO: 9723 - DNA, 1034 bp, Homo sapiens; identical to SEQ ID NO: 9706
  ENST00000421296

SEQ ID NO: 9724 - DNA, 1721 bp, Homo sapiens; identical to SEQ ID NO: 9707
  ENST00000489994

SEQ ID NO: 9725 - DNA, 664 bp, Homo sapiens; identical to SEQ ID NO: 9708
  ENST00000470441

SEQ ID NO: 9726 - DNA, 437 bp, Homo sapiens; identical to SEQ ID NO: 9709
  ENST00000462155

SEQ ID NO: 9727 - DNA, 3232 bp, Homo sapiens; identical to SEQ ID NO: 9710
  ENST00000621379

SEQ ID NO: 9728 - DNA, 3397 bp, Homo sapiens; identical to SEQ ID NO: 9711
  ENST00000535603

SEQ ID NO: 9729 - DNA, 1102 bp, Homo sapiens
  ENST00000554026
cgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagcggtacccaaacaggcaaacaacagctggatctgaacgcatgctatcacaaaacgcatcacagagatttggggctggcttcattggaagaggcagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccac

SEQ ID NO: 9730 - DNA, 1765 bp, Homo sapiens
  ENST00000555305
cgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataaggagactcattcttcactcgcatcagggtttggtggctgttgtgacaatattctcctttctcccctcttcctgcagtccatgccttgagctccaaaagcttctacaggttcccagagcctcatttctgattctcatgggaaggggccagccagcagccctgagaattccatggaagccctctcttacagagcctgggcctcccttctccttatccttttagatacgttgcagccatctccaccgctgcaagtattataaccgcctggttccaagatgtgctgagatcaggagcagagtcccacccttctcctaaacagagctgtcttttgtttttgtttttctcttttcctccctgagacttcttatctgaggacagagccccttcgctgcctgcttctcttggatgcggctttgggttaggctggcagcagctaactaaggcccactccccggccatagggagcgctgagtgcttctgttatcctgcctggaaagcccttcattaaaattc

SEQ ID NO: 9731 - DNA, 460 bp, Homo sapiens
  ENST00000555370
cggagatggaggatttgctcgacttggacgaggagcttcgctacagcttggctacctccagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggaggta

SEQ ID NO: 9732 - DNA, 816 bp, Homo sapiens
  ENST00000238628
cggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacggtacccaaacaggcaaacaacagctggatctgaacgcatgctatcacaaaacgcatcacagagatttggggctggcttcattggaagaggcagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 9733 - DNA, 848 bp, Homo sapiens
  ENST00000556742
gagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagagtacgtttccagtattcttattcttatggtatcctatgttgatcttggtcaacagtgcagtcttggtggtcatgatctgttccacctatgttgaacactgtgttagaagtctggggctagaattattgatgcctgctgaatccaaggtttggttaatcccgcttcctcaactgaaggtctggaccctggcattgatgcccatgtcctatctcccactgtgtggttttagaattatatgtccaggtatcagggtactggcccatgccttctgcattattgatatagatgggcagaagcaataccagcttctaagccttgccttctcataagacttatatcagaaaagaaagaagttttctagataaaggtgctgtgaaggtagggccacccagtttcctactcccaggggcggaagctgcattcatgtcatagcctctgtgatgctgtcctctggaatagtgcatcgcacagcctgtgcaaccacacacggcacacccagtggcctaattaggtttgactaagttgacagagaaaaacaggttcagggacattttcatctaggagaaagaatggatacaataaacatttgggatgttc

SEQ ID NO: 9734 - DNA, 684 bp, Homo sapiens
  ENST00000553338
atttgctcgacttggacgaggagcttcgctacagcttggctacctccgtgaggaccaattcgggggccttgggggccaggatttggcgggtggggaggagcgaccccgccggccccgacttctctgaggcgactcagggcggcaggcctcgcgccgcgccgggtgaggcccagaaggaggcagcctcaccgccccgcccccaggccactgtgggctccgccgctgctggcctggggtttgctttctttaaaatcctcagaaagtagaaaacaccctgtccccgccggcgtctaggaccgtgggaaatttccgagcctttctccgttttctagagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggaggcaggcagggacggcctttcttcccgagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtgagtac

SEQ ID NO: 9735 - DNA, 472 bp, Homo sapiens
  ENST00000553438
agacttcctctgctaaattacctcgctgccgacagggaggctgggcaggtgattccgtgaaggcttcgaaccgcaaagaacccggaatcagtatggcatgaccggagtcctgggcaacgtgggttcttaactgtcagtcagatattcctatcattccggatctggaggaagtacaggaagaagactttgttttgcaggtggcagcccctcccaggtaggttaaatcagatatgattggggaggcaaagaacacgtgaattaatacactccagatatcatctatagtggaccttgatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagat

SEQ ID NO: 9736 - DNA, 526 bp, Homo sapiens
  ENST00000554423
gtgtgaagggcacagaaaagcagttccaaagtctgaagcctgaactgcgaggcgaggacatccctttttgctcgttgcaagtcgcaagtgctgacagctaacaacaccaaataagacccagggtctcagtcctaagaaagcactctataaatcagtcagttaattgctgaaagaaaagagggcactgaatcatctgtatctatttgaattttaagccactcgctcaacctgcacttacactctcaacaatccaatttggagtgaggctgacataaagctgtaagaaggcactacagcatcttcagttctctcatgctggttgtggggcttgtctctaaagaggactgcagacaaataaagcacttgagatatactaatttgcctccacttttgaaaccttcctcaagatactacctggtgcatgagactagtgggctctcaaaaaccttgtcttttctttttttttttcaggtttaggaggaaggcttctgaagaaatagaagatttccgcctcagaccacagagc

SEQ ID NO: 9737 - DNA, 635 bp, Homo sapiens
  ENST00000554233
agtcagttaattgctgaaagaaaagagggcactgaatcatctgtatctatttgaattttaagccactcgctcaacctgcacttacactctcaacaatccaatttggagtgaggctgacataaagctgtaagaaggcactacagcatcttcagttctctcatgctggttgtggggcttgtctctaaagaggactgcagacaaataaagcacttgagatatactaatttgcctccacttttgaaaccttcctcaagatactacctggtgcatgagactagtgggctctcaaaaaccttgtcttttctttttttttttcaggtttaggaggaaggcttctgaagaaatagaagatttccgcctcagaccacagagcctgaatggatcagattatggaggaggtaagaggcccttggaggaagtcaaaaggtcttctagagaggccccagaacatttcctgggctacagctaaggcactgttggctgcagcatcactgaagacatttgcagtggtcttctgacgcatgctgatgcacatcttcatgccttgctgaatgctgccacctctacctggagtatctctcccttctttatctgataaccctgcttatccttcaaaaggtcagccaaagcatcac

SEQ ID NO: 9738 - DNA, 833 bp, Homo sapiens
  ENST00000314067
ggtttccaggaagtgacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctcctc

SEQ ID NO: 9739 - DNA, 487 bp, Homo sapiens
  ENST00000555677
tttcagagggtcctccgcggaagggcagctgaatggactccagagcagccttaaccctgcagcctttgtgcccatcaccagctctacagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtgagtaccagcagctcataagagtatgggtgggggtgcacacggttggggggactttgctcctgtgttgttttattttttacaatagctttattgagaaaaaatttatataccatacaattcacccacttaaaatgcacaatttaatcattcttaatatattcacagagttgtgcaaccattaacacaatcaattttacaacattttcatcacctccccaccaaaagaaaccctgt

SEQ ID NO: 9740 - DNA, 1014 bp, Homo sapiens
  ENST00000542766
gtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataa

SEQ ID NO: 9741 - DNA, 4479 bp, Homo sapiens
  ENST00000327987
agcggtgcgagtgtggagcgcgcaccccgggcgaggctgacagatcgcccgggtgggtgcaagatggcgcaagcggcgctccccctgcgccccccgcgctgctgagcaggcatgcggccccagtcccccaccgcctgggctcggccccggccggagccccagccccggccccggcgccggccccgcgggacgctgtgagccgcgagaggcccgggagccgcgcgtcgccgagccgagctgaccgagagccccatggctgtgcagcgcgccgcgtctccgcgccgcccgcccgccccgctctggccccggctcctgctgccgctgctgttgctgctgctgcccgcgccgagcgagggtcttggccactctgctgaactggcatttgctgtggagccaagtgatgatgttgccgtccccgggcagcctatagtgctggactgcagggtggaggggacccctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaaccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctagccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtggcctcagcccccttaccccacagagcccgaatgcactcctacctcaagtccccttgctggggaccccctctcccttcccacactgttgtccagagtaaaaaaaaaaaaaaaaaaaaaagcacttccccgtttccaggtgtgaaagaaaaaaaaaagcacttccccatttccagatgtgaaagaaaatgtctacctcaaggctcgctggctctgtgggctgtgttgtcactggacctgcctccccgcccctcctgcccacagcccacctacctctcctgcagaggagaggccagaggttgggccaccaaggggaactcttgtggcctacagaaatagaaatggattgggcagagaaaaaatgtgaaagcagccaaaaatgagaggaaatttgttccttgaagtataaattgtccaaacgagccacctcccagcacaccgcctgtccccgtcttgtctgtccactcccattttgagccagcccatccttgatggggatgcccatgaggaacctgggcttgggagggtggcatcagctggccgcctgcctcctgtcctgcaggcccggcccctggaatgtaccatgtgtgggatgggtgtgtgggagggtgagggggtgtgggtgtcccctgcagaggcgccccagcctcaggcacccagccagcctgatccacccctcgacaggggagcatccactgtcagcagccatggccggaagctatttttatacaaggtgtgttaagggttatgttcttgtgactttttgttactcttttctgttgtgttgttctttgaactacttagttaaagaagaagaaaagaaaaccaaggaaacaaatacctatttttggttatactcagaaacatttttttaaatagcagaagaaaaactttttttaaagaaaaaagataagtgtattccttaagaatgagaccataaatatccctgacccccaatcctctagggacacctccaccctgaactttagttaattagctgaagaagatagaatttgtggtgttttcctagaaaactagagctgtgtccgcgtggacttggggaagggtagtcccttcccttctcccaaatgatgtgtggatgcccagggctccacaaagctccaaggcagtgccccctctgttcccaaagcagcttctctcgggagcctccctctcccttgggaagggtgcggctggggcaggagggggctggggggccacctggccttacttgggttttgtcacactctgctcattttgactgaataaaagtcctgttgccaaagtgaa

SEQ ID NO: 9742 - DNA, 1783 bp, Homo sapiens
  ENST00000558354
atttccctcttcccgactcctctagtcccttcatcagtccaggctccccacagtgccccatcttccctcttcttttcccagtctttctctcctgccttctctacccgcatctctcccagccattgcctaaacctcggcagtcctttcaggttggtggcacacagctgggcactaagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagat

SEQ ID NO: 9743 - DNA, 748 bp, Homo sapiens
  ENST00000559231
gggaatgtggaatcctgtttgttctctgtgggggtccattctatccctgtgacctgggaagaggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacac

SEQ ID NO: 9744 - DNA, 564 bp, Homo sapiens
  ENST00000559058
cgcgagtgcgccggggccgggcccagctggggaatccgaggctctgggggagggggtggcgggaaatggtgcctcgctcgccccagcgacatcaaaccctcgtttggcgtgcgaggacaatggctgtcttattttctccattcgccgcgcacaatgccggattctctcattcacccgcggtggtgcgagcgagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtc

SEQ ID NO: 9745 - DNA, 844 bp, Homo sapiens
  ENST00000559947
ctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaaagtcttgttctgtcacccaggctggagtgcagtggcacgatctcgactgactgcaacttctatctcccgggttcaagcaattcttgtgcctcagcttccccagtagctgggattacaggtgcgcacaattacgcccggctaatttttgaattttttggtaaagatggggtttcaccatgtttgccgggctggtctcgaactcttggcctcaagtgatcctcccgcctcagcctcccaaagtgctgggattacaggcgtgagctcctgcacccaggtctagctaacactttttaagtacttgctgcatgctgggcaccctgtccaagtgctttacatgaattacttcattttgtcatcacaacagccctgggagaatggaagataggtcattatcatcccccttttacagaagagaaaactgagccttagggggactcaatggcattctggtagcagaagagccaggactgtcatctgggcagcctgaacccacaccctcccacttagctcccgtggcacgccgcctctttcctgtctgatcgctgacaagtttcttcctggctctgagggcatttgcacagttgctctgaacggctggtgagtgatgaatcagtttgaggcaggagccctctcgctgggt

SEQ ID NO: 9746 - DNA, 6508 bp, Homo sapiens
  ENST00000352385
ctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccagaaatgtggaattctcttttggaa

SEQ ID NO: 9747 - DNA, 3407 bp, Homo sapiens
  ENST00000558048
acaacgcgtggctatgcgagcatggctctacctcctcttcggagccggctgcggacgctagggcctctctccctcctccacggaatggttggctgtcagggaagcacatgggcctccatatcccggcggaataggtcagcttggttctcacgaaggaaagggcctcccagcaggtgacccagggtagccagaacacccagctccctcctcatccctggagctggggagacctctgagacccagacatccccgtgtggggagaagaggccagtcggcttggctgtggccaagtgggactgggaccaggataagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccag

SEQ ID NO: 9748 - DNA, 5544 bp, Homo sapiens
  ENST00000559327
agcaatatttaggggaggctgaggaggcctggggacagttttgggagagaaagagaatggtcgttgtggggctggggtaaatggggagaagaaagggtaggtctgcgctgagccggagtagtttggaaagggtgaatcagggagaggttaaagtgattggaaggggagcgagggagggcggtggggggcaggcttggggtactggggggggggcagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccag

SEQ ID NO: 9749 - DNA, 469 bp, Homo sapiens
  ENST00000561309
gccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaaggtcagcgtcctggaaggaaggggcaggaaaggaggaaagggtctctgtgcttgtgaagaggaagtaatgagttctctggagacccctgggtggtaactttcctggg

SEQ ID NO: 9750 - DNA, 539 bp, Homo sapiens
  ENST00000560319
atgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaaggtaagtcagagccccacattgcggctcttttctaaataggacaccagggggcgacagagcacaacgcgtggctatgcgagcatggctctacctcctcttcggagccggctgcggacgctagggcctctctccctcctccacggaatggttggctgtcagggaagcacatgggcctccatatcccggcggaataggtcagcttggttctcacgaag

SEQ ID NO: 9751 - DNA, 578 bp, Homo sapiens
  ENST00000558819
attcgtgcctagcccacggccccctcggagtgctggccagccagactgctgtcgtcaagcttgccagtctcttcctggtattgtctatcctcattcttgggtattccataatcttcccgcttcttctccactcccctgttccttctgcttttctttccctttgagtcctagagtctgggcttgtgctgtcctccagggagcctgccagagtgccccctttgtgtcagaggcacaaagctgcctcctaagggagctcctgcctgcacggcaggtggaacatgtggagccaaaccccacgctccagccttaccccttagggggctctcaggaggcacagatcaccatgaagtaactttcaggccagaagaagtgtgcatcttactgtatagtttgaccatcatgatgatgttgggcaggggggctttggaattcattctgctggcagtatctgaccgctaatcaccacttcttgttgtgtctccctcggtctgaattggctctgctgtgtgtttctgtgactgtgtgtttctgtgtctccatgcggatgtgtttcactgtttgtgcttgctgtggcttct

SEQ ID NO: 9752 - DNA, 5585 bp, Homo sapiens
  ENST00000416167
gcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 9753 - DNA, 1583 bp, Homo sapiens
  ENST00000434045
cactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaat

SEQ ID NO: 9754 - DNA, 1005 bp, Homo sapiens
  ENST00000381392
aactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaa

SEQ ID NO: 9755 - DNA, 1023 bp, Homo sapiens
  ENST00000381389
tccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcgacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaaccc

SEQ ID NO: 9756 - DNA, 934 bp, Homo sapiens
  ENST00000418738
ggcactgaccagcctgcaaactggacattagcttctcctgtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccc

SEQ ID NO: 9757 - DNA, 4527 bp, Homo sapiens
  ENST00000381395
gcaaactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 9758 - DNA, 5179 bp, Homo sapiens
  ENST00000381406
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 9759 - DNA, 2322 bp, Homo sapiens
  ENST00000381086
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaata

SEQ ID NO: 9760 - DNA, 2262 bp, Homo sapiens
  ENST00000275521
ccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgct

SEQ ID NO: 9761 - DNA, 583 bp, Homo sapiens
  ENST00000460209
ggtgtcatgtgaggctggatgtgggctccaaagtcatagctgtgacattcgcaggcagcggggatgttctcagtcccacatttggcagagaagtcagtcaagaggttctacaagggctggtgtccaccttatactcctagaaacacaaaactgcccccacccccgctttcttggagcaggaagttacacccacacgcatgcacaggcgcacactcagcgggcctaggcacgcatggctcttgtgttgccttagctgaaatttctgttgtgctttctcagcatagcagagtcacgctggcaaaccatcatgcgccctggccaccgacctgacaccagacccaggagcattcacttctctgtcttctgtttctctcccacagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcag

SEQ ID NO: 9762 - DNA, 1050 bp, Homo sapiens
  ENST00000381083
gcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttatttt

SEQ ID NO: 9763 - DNA, 894 bp, Homo sapiens
  ENST00000428530
tggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatt

SEQ ID NO: 9764 - DNA, 810 bp, Homo sapiens
  ENST00000417621
gtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtct

SEQ ID NO: 9765 - DNA, 571 bp, Homo sapiens
  ENST00000448817
gggcgcatcttcagatgcgtatttgtgggcccctggggatataaacagcccagcgggtgtaaattaaaccccgcagtgccttggctccctgagacccaaatgtaagtcagaaatgtcccaagacttcgcctgccaacggaattaaattttagaaagctccacgaggtacacacgaatgcggagcgctgtatgccagtttccccgacaccggctcgccgcagggagacctcaccccgagagcggaaggggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaag

SEQ ID NO: 9766 - DNA, 663 bp, Homo sapiens
  ENST00000465642
attctcctcgccccgcacgggggtgcacacggactgcaatcccagggatgcttggggatgggggggatataggcggatttggaccaaggaaggtgggcaggcacgttgtaggaaatagtacctctcttttaaaatactgactttgcacagccttttggtttgcaaagcaatgtctagtcccggtatgtccaaaaacaagtaaagtggattcgggttttgatatcttctgcggttggaaaacctgaagctgaaaaagaagtaacttcttaaggttacccagcggccacaacagagtgtaggtttgaactccgcgtgccactttcagtaccataccattcttacaactcgggccacccctgcacctgcgccgacctcaaacaaacttccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagtt

SEQ ID NO: 9767 - DNA, 574 bp, Homo sapiens
  ENST00000460477
cttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactct

SEQ ID NO: 9768 - DNA, 2412 bp, Homo sapiens
  ENST00000613132
atgcagcgggcgcgacccacgctctgggccgctgcgctgactctgctggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaagggg

SEQ ID NO: 9769 - DNA, 792 bp, Homo sapiens
  ENST00000615754
atgcagcgggcgcgacccacgctctgggccgcttgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtag

SEQ ID NO: 9770 - DNA, 6215 bp, Homo sapiens
  ENST00000233813
ggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaaacgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 9771 - DNA, 551 bp, Homo sapiens
  ENST00000486341
atgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcaggtgcatctcggggattccctcattccctcccagcttttgaccttttcctgcatctaaatggacattcatggcggcaggaggtgctagactag

SEQ ID NO: 9772 - DNA, 718 bp, Homo sapiens
  ENST00000449583
agggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgggtgtgctccaggagggcagagacacatctgcttcagcctttattactcccctcaccccaaactgcccagccctgggctctggccgtgtgcaccttggcccacgggggctgaccctccggctccttctcctgcagagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgag

SEQ ID NO: 9773 - DNA, 3525 bp, Homo sapiens
  ENST00000425327
gtgcgtcagggagagtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataagttgtcattaattatcaatactaacgagtatgtcattttaaaacttagtattctctttaatgttacaaga

SEQ ID NO: 9774 - DNA, 3495 bp, Homo sapiens
  ENST00000393775
agttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataa

SEQ ID NO: 9775 - DNA, 3320 bp, Homo sapiens
  ENST00000489689
acagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcagcccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatat

SEQ ID NO: 9776 - DNA, 1952 bp, Homo sapiens
  ENST00000441144
aagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggtgggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcagcccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagttt

SEQ ID NO: 9777 - DNA, 1487 bp, Homo sapiens
  ENST00000491903
agtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcacgggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaa

SEQ ID NO: 9778 - DNA, 684 bp, Homo sapiens
  ENST00000459718
gtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcagggtatgtacagtgctgctttacccattttattagttatcatggacaattctaatattcaaaaagtaattaactttaataggttttgaaaaataacaccctataactgctgaaaaagctttctggatcattttgtgttttcaaatttaaagtgaataaaagattttctctctcttctcta

SEQ ID NO: 9779 - DNA, 864 bp, Homo sapiens
  ENST00000483401
aggggcagaagaagtgagcctagaaggatggacttgctgaacttctgtttatcctccaagatgtgattagtcttcatagaactccatagaagttcaggaagcaaggagcaatttgactttagcagcagtgtggaggatggattggaagtggaccggaggagatcagttgaggctgtcgtggttgttaaagatcatctctacacatatttgagggccagtgtccttaactgtgtcttgtatatttgagaagccgtatgccataatgtattctggagcacacttcttagatttgaatctcagctagcccacttacacacttagacccagaaagaagagggcagcacacctcagggccagcaggaggaaggggagtcatccaggacatgtactctcaactggcggttgggaagaagacagaaagagatagacatgtgggtcgaagtctttactggggtccgtcgtgttacccaagtggctaaagcaatcctagtgagacaatggcatgagtaatagtaacagaggagttaagcagttgtgattttctgctccaataatagaatggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctacc

SEQ ID NO: 9780 - DNA, 738 bp, Homo sapiens
  ENST00000480431
ggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtggctaaagcaatcctagtgagacaatggcatgagtaatagtaacagaggagttaagcagttgtgattttctgctccaataatagaatggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggt

SEQ ID NO: 9781 - DNA, 503 bp, Homo sapiens
  ENST00000494802
gagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggtgggaggagccaagatggccgaataggaacagctccggtctacagctcccagtgtgagcgacacagaagacaggcaagaagaataaatgtctctggtggaacttttgctctggtggaactgcttttctagaactggtggctaaagcaatcctagtgagacaatggcatgagtaatagtaacagaggagttaagcagttgtgattttctgctccaataatagaatgaagtctcaagttttcatgtagacacaagtccctgagacctgccgtgccccagcagatttcctgca

SEQ ID NO: 9782 - DNA, 3206 bp, Homo sapiens
  ENST00000354673
ttctcaccttcctcaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcat

SEQ ID NO: 9783 - DNA, 7254 bp, Homo sapiens
  ENST00000369486
ggggactcgggaggggccgcagcgcggctgctggtgccgttgcgggagaagaggaagcggcgcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaat

SEQ ID NO: 9784 - DNA, 3842 bp, Homo sapiens
  ENST00000318837
ttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctgggg

SEQ ID NO: 9785 - DNA, 268 bp, Homo sapiens
  ENST00000481589
gagagaagaacctgcattagccgtttaagtgtgcggtgctggcagagtacctccctgaaggtgtcctggggaaagtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttc

SEQ ID NO: 9786 - DNA, 7326 bp, Homo sapiens
  ENST00000369483
gcggggactcgggaggggccgcagcgcggctgctggtgccgttgcgggagaagaggaagcggcgcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaatacggctgttt

SEQ ID NO: 9787 - DNA, 2840 bp, Homo sapiens
  ENST00000495759
gacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtcttgaactcctggcctcaagtgatcctcctgccttggcctcccaaagtgctgagattacaggtgttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 9788 - DNA, 5905 bp, Homo sapiens
  ENST00000374647
agtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 9789 - DNA, 437 bp, Homo sapiens
  ENST00000467959
ttactgttaagggacgaagtggtttagtgagagataccaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaa

SEQ ID NO: 9790 - DNA, 3823 bp, Homo sapiens
  ENST00000537196
gggtgcggactgtgggagctgactctgggtagccggctgcgcgtggctggggaggcgaggccggacgcacctctgtttgggggtcctcagaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttg

SEQ ID NO: 9791 - DNA, 1447 bp, Homo sapiens
  ENST00000320650
gggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaa

SEQ ID NO: 9792 - DNA, 2472 bp, Homo sapiens
  ENST00000296545
actccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaa

SEQ ID NO: 9793 - DNA, 1388 bp, Homo sapiens
  ENST00000514653
cctgcagccaggactcgatggagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgc

SEQ ID NO: 9794 - DNA, 1355 bp, Homo sapiens
  ENST00000529613
cacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagtttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcgattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttg

SEQ ID NO: 9795 - DNA, 6026 bp, Homo sapiens
  ENST00000477265
catttgatgtgtccatcattcccttttgctggatatacttcccttgactgacttctagaatatgatactcttcattttccccttattcagtagtcattccttttgatttttctttcctggtccttcttttataatccttgacctaattaatactgaagtatcccatgctcaggttttggtccttttctctacctacatcactccctcatgagcactctgatgagttgcatatctatttccagttcagacacattcctgaactcgagatttatgtatccaatggcatatttgatatttccttgtgcatatctaatgagcctttcaaactcagcatgtccagaactgaaactcctgacctgtcccctctcctcaaggcatcagctgtgtccaaggcttgcttttttcagttgatgtcagctccatcttctcaggtgttcagaggaaaagactcagagtcattctcattctctttttcctcctgtaccctgcaatctgtctggaaattatattagtcctatcataaaaaatgattccagactctaaccacatgtatctatctccactgctaccccaagcagattcaggtcctcctctcctccacctttctgacctcatctcagactactcttgcccttgctcattccactggcttcttttctgtcccttagactcatagccacacagttgcctctgccctagctattccctctgcttcaaatagtcttcactgagataccaccggggctcacaccctttctatctttaccctgactacccaaaatttcaacctcacccttcttaccttgtttcctttttcctagataatttttcactctctaataaaatacataattataataacttatttgtgcattttctatatggttcatctttctttctgaaatcaagattgtgttctgccatcattgatgtattccaaggtcataaaaaatgcctagcccataataaatattcagtgaatatttactaaatgaatcaaggaaagtgatgttgtcttatagtctctatattctattcagtctcggcttgtcttttctagtggtttgaatgaatggatgatgcatttaacccagaaaaccaatacttgtaaatcttttattcttgtatgtttaattaattttaaatgtgtgattagacaagttaataagcagaacaaaacatcaagtatgttagatcatctttcctcactgggaagaactataatattggtatagaatgtaagatgtttacagttattttcacaagcaatgatttgcttgggaaatagcaatggtgtgagccccgacagtatctgggtgaagaatatttgaagcagaaggaaaatctagagcagaggcaactgtgtgactacgagtctaagggacagttttcactccagaatgaaaactatagagatgcctgcctgcgttaacttgctcacctcactatgtattttccctgggcagtaccatcctgctaggatttcagtgctgccatgagtcagcagtcaccttgcagtgagatccaatcacaagattccaaacaattcctaccctgtgagctccttgaggacagggctgggatttagtctcttttatttcacaggcccagagttctaggatggcagaatggtttcgggtgccaggccccacctggttgctctccatgggcatactgcccagggctgccttgggacttggctccctacattttggtgcagcagtcttcagccaccccaactatggcttaagtggccccagctgcagcttgacccactgcttcacaagatacaggtggtaagccttggtgaaattcatgtagtgttaagcctgcagtctcacagaatacaagagctgagggggcatggcttcctccactttgatttcaaaagatgatgctgacttatttggggcacaggcagagactttgcacaggggtagaaccaccacagagagcccccaacagggcggtgcctcatggagccaaggaaatggggttgccaccaaaatcctagaattatggttaacagtgtagagctgcagtctggaaaagcttcaggcatgagactccaacccatgacagctgaagaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaactgtgagccaaatgagcttgtgtcccttgtaaattaagtttgtggtgttctcttatagcagcagaaaatggattcaggcagcaagcagagctataaaatacttctttttttttttttttgagatggagtttcacttttgttgcccaggctgtagtgcaaaggcatgatctcggctcaccacaacctctttctcccgggttcaagcaattgtctggcctcagcctcccgagtagctgggattacaggcatgcactatcacacccggctgattttgtatttttttgtaaagacggggtttcaccatgttggtcaggctgatctcaaactcccgacatcaggtgatcctcctgcctcggcctcccaaactgctgggattacaggcacgagccaccatgcccggccaatacttcttttcatctacactggcttccattatcatgattttgttagatacttttgaggacattttctattgcattcctccatgtttggcaaccacactctatggtggagtcttctggctaagcacttagtcttcttttacttataccagcaggatgtagttgagcagggtagtgaaaatccattgtgacattgtaaagcctcactgctataagaggccaggaatgaaattttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatctgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggc

SEQ ID NO: 9796 - DNA, 645 bp, Homo sapiens
  ENST00000505351
agacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttggggtaattttatctttaggcataaataacattatgttcatggtcatgatgattgtccttggatatattttccattaaattagtttacgttcagtttgcttatatctctaggtactcagtatctgggggatagaaggcagactacagagatttagagaggtttggtaaacacctaactgagcatttttctacattgtggtaata

SEQ ID NO: 9797 - DNA, 272 bp, Homo sapiens
  ENST00000509249
ggctgttgaatgcacagaagcaaggataacactgattttttcactggtcagaataaaaattattgattgctcttttgcttatagtattcatcaagatgaataggctccttcaaaatgctttgctctatggtttttctttcagctgtttcagtgcagggcttcctaaaacagaagccaactgggtgaatgtaataagtgatttgaaaaaaattgaagatcttattcaatctatgcatattgatgctactttatatacggaaagtgatgttcac

SEQ ID NO: 9798 - DNA, 1545 bp, Homo sapiens
  ENST00000394159
atggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcacctt

SEQ ID NO: 9799 - DNA, 545 bp, Homo sapiens
  ENST00000560989
aatccgctcgggtccccttccacaagaagctttgttcttttgctctttgggtccacactgcctttatgagcagtaacactcaccgcgaaggtctgcagcttcactcctgaagccagcgagatcactgagcccaccgagaggaacgaacaactccagacgcgccaccttaagagctgtaacactcaccgcgaaagtctgcagcttcactcctgagccagcgagaccacgaacccgccagaaagaagaaactcggaacacatctgaacgtcagaaggagcaaactccggacacgtcgcctttaagaactgtaacactgaccgcgagggtccgaggcttcattcttgaagtcagtgagaccaagaacccaccaattccggacacaacgccgttctcctgcctcagcctcccgcgtagctgggactacagccgagaagctgccatcgatcctcccatggacccctgatcctggtttggaggaacttttcacagctctctctccctccctcaaaccctgtgcaatgagtttgcagaagagagtcttcccg

SEQ ID NO: 9800 - DNA, 2977 bp, Homo sapiens
  ENST00000560241
catttgcttctcaaggagggcaggagttggaagcgaccgttgtgaaacgttaaagattttctggcagagggaaagggattttttttttctccctccctgccgaggaaaaaacagttctaacgaggagttactttgtagttttaactcatattcaaatactcccagccgagaagctgccatcgatcctcccatggacccctgatcctggtttggaggaacttttcacagctctctctccctccctcaaaccctgtgcaatgagtttgcagaagagagtcttcccgagaaggcagaacgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacagaaggaagaaatggaggctcaggaggttaagtaacttgtctaggtgttcacacctagacagtagaggaaccgggactagaacacaagcctttttgactctaggactcatactcttaactattactccaaagtgataataaactgtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccag

SEQ ID NO: 9801 - DNA, 5120 bp, Homo sapiens
  ENST00000360547
agtttgcagaagagagtcttcccgagaaggcagaacgagggtgtgtggagcactgcgggcgagatggagctgagggaaggcagagctgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgaca

SEQ ID NO: 9802 - DNA, 2158 bp, Homo sapiens
  ENST00000559383
cacatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggaggtaggtgggcaccagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcc

SEQ ID NO: 9803 - DNA, 9616 bp, Homo sapiens
  ENST00000394660
acatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagccatatacaaggtctatatcagaaaaatatatttggggggctgcagcacaggactgagggagcggtacatgcttaaaaggcaacagggcctggttttcagtggcgatgatgattctctatgacagtcagggaaacgtggtctctgagagtgatgggcacataaagccttggtgccagagtgcatcgcatggtgtccaggccgagtctctgtcagatggttagaggcctgggtctaccctgccaggagaggcgtgtttgggtaacaggcagatggagtttggaacacatgaatggctcatcacacgccaaccctgagtggggcaggaggcaggaagggtgggctgccgcctctggttggcattctcagagatgcgcagtccatcagcttgttccaaagagtgaacacaggcctctgcgtgctcccaggctccttggtgtcccaacagctggagctcctcgatgagtcacgggagttctttgccaagaagtaacgatagcattactcatggaattgcttcactgctttctgaaggttggcataaaaccgggtcatgctgcgggggaagaaggagtccaccacgttctgtgggaggtaaccgctgaggtcggtatggaagaatgtgaccaggttggtcttggtgggttccctgtgaaggcaacagcagagctgtgttatgatctgcagcagaggtgctggggacgagcgccaggcaggtgagcagagcccagcccagtggaaatggccatgatacagtgatcgcgtctcatcccttgctgtgccctccacccaggagtcctctctggacctgctgattttcaggatggaaacccatcctgtcggggatgcattccacagcctctcccggcctccagggaggaagaagtccctactcccagcccaaaaacccagtaccctgctgcccgattcactcagcaaatgctttcagagaactcactttgtgccaggccctgagaggaacgaagagatgctgcccttcactatttagggtctgcaacctcctgggggctcctgggaccctttcaaggggtctacaaagttaacactatttttataacaacacgaacatgtgattcgccttctctcacatgcatacagtggggttttccggaggttacatgatatgtgatattgcaacagactacacgcacaagcaggtatgagtttctgttaagcctggcatgaaagagatgggcaaaaatataaaaacaatgccactcttttcacagtattttttgttttaaaaaaatagttttttaaaataaaaatgttatctatgttaa

SEQ ID NO: 9804 - DNA, 3999 bp, Homo sapiens
  ENST00000302987
atggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctag

SEQ ID NO: 9805 - DNA, 3775 bp, Homo sapiens
  ENST00000560115
gcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggggctaattctgaagtctcccatgaagaggatgcaatattggatgtgttgatgaaaagacaaaacacatttgtgctgttctaagttgtaaagctgcattgactgcagttggtatcacatgtggctgcctgtaaaagagctaacaattcatgaatgtcaacagatgtcaacttacagagctcccaaccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggtg

SEQ ID NO: 9806 - DNA, 2397 bp, Homo sapiens
  ENST00000394652
ctgtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttatta

SEQ ID NO: 9807 - DNA, 626 bp, Homo sapiens
  ENST00000560230
acagcagggagaagccctagtgcctctgccggctgcccaggacctggtatcggcccacagaccaagtcctccacagagggcgagccagggtggagaagagccagcccagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcct

SEQ ID NO: 9808 - DNA, 1922 bp, Homo sapiens
  ENST00000558857
agtgcctctgccggctgcccaggacctggtatcggcccacagaccaagtcctccacagagggcgagccagggtggagaagagccagcccagcttggaaactagaatttaggaagaaaagtcactgtatgatgtaatgcacagctttggccttgtttctgcactgtagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggtg

SEQ ID NO: 9809 - DNA, 2020 bp, Homo sapiens
  ENST00000558332
agaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaatt

SEQ ID NO: 9810 - DNA, 561 bp, Homo sapiens
  ENST00000559342
aaatgagctcaggctcatgggtcctgcaccctctaggtgctgccccaggcctccgtaggcttttggcactagaatgatccaggctaggatgagaggataaggaggttctcgttttccatacaaggaggcctcatagctgcaatttccacatcaagagtgtagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaag

SEQ ID NO: 9811 - DNA, 525 bp, Homo sapiens
  ENST00000559953
gctggcctctgtgccagcagctccaatctaggacacaattatctttaatctttgttggcctaaaaatcctctagcattgactaaccggttcaatcctcctccagcaagtatgtggactggacttgtgtgatttctggtcctgacttcctttggtttgctcaggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcacc

SEQ ID NO: 9812 - DNA, 1147 bp, Homo sapiens
  ENST00000280357
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaa

SEQ ID NO: 9813 - DNA, 1090 bp, Homo sapiens
  ENST00000524595
gcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 9814 - DNA, 1697 bp, Homo sapiens
  ENST00000525547
ggataaaacccaggaggtagaattgctgggttgatagaagagaaaggatgattggcaaattaaagcttcagtagagggtacatgccgagcacaaatgggatcagccctagataccagaaatggcactttctcatttccccttgggacaaaagggagagaggcaataactggtgctgccagagttaaatttgtacgtggagtagcaggaaatcatttgctgaaaatgaaaacagagatgatggtgtagaggtcctgaagagagcaaagaaaatttgaaattgcggctatcagctatggaagagagtgctgaactggaaaacaaaagaagtattgacaattggtatgcttgtaatggcaccgatttgaacgcttgtgccattgttcaccagcagcactcagcagccaagtttggagttttgtagcagaaagacaaataagttagggatttaatatcctggcaaaatggtagacaaaatgaactctgagatccagctgcacagggaaggaagggaagacgggaagaggttagataggaaatacaagagtcaggagactggaagatgttgtgaaatttaagaacacatagagttggagtaaaagtgtaagaaaactagaagggtaagagaccggtcagaaagtaggctatttgaagttaacacttcagaggcagagtagttctgaatggtaacaagaaattgagtgtgcctttgagagtaggttaaaaaacaataggcaactttattgtagctacttctggaacagaagattgtcattaatagttttagaaaactaaaatatatagcatacttatttgtcaattaacaaagaaactatgtatttttaaatgagatttaatgtttattgtagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataa

SEQ ID NO: 9815 - DNA, 795 bp, Homo sapiens
  ENST00000528832
gctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcagatggctctttgctttcattaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactag

SEQ ID NO: 9816 - DNA, 758 bp, Homo sapiens
  ENST00000533858
gccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttataggataaaacccaggaggtagaattgctgggttgatagaagagaaaggatgattggcaaattaaagcttcagtagaggaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaa

SEQ ID NO: 9817 - DNA, 880 bp, Homo sapiens
  ENST00000534225
ctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatggtaaagtagaaatgaatttatttttctttgcaaactaagtatctgcttgagacacatctatctcaccattgtcagctgaggaaaaaaaaaaatggttctcatgctaccaatctgccttcaaagaaatgtggactcagtagcacagctttggaatgaagatgatcataagagatacaaagaagaacctctagcaaaagatgcttctctatgccttaaaaaattctccagctcttagaatctacaaaatagactttgcctgtttcataggtcctaagattagcatgaagtcatggattctgttgtagggggagcgttgcataggaaaaagggattgaagcattagaattgtccaaaatcagtaacacctcctctcagaaatgctttgggaagaagcctggaaggttcccgggttggtggtggggtggggcagaaaattctggaagtagaggagataggaatgggtggggcaagaagaccacattcagaggccaaaagctgaaagaaaccatggcatttatgatgaattcagggtaattcagaatggaagtagagtaggagtaggagactggtgagagaagctagagtgataaaca

SEQ ID NO: 9818 - DNA, 427 bp, Homo sapiens
  ENST00000484501
gcagaaatggcattaaatgaaagaggacatgaaggggatttcctcattcgtgatagtgaatcttcggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagccatccttacccgacctgggatggagatcaccaaagatggcttccacctggtta

SEQ ID NO: 9819 - DNA, 2047 bp, Homo sapiens
  ENST00000329582
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 9820 - DNA, 1887 bp, Homo sapiens
  ENST00000469964
cagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 9821 - DNA, 956 bp, Homo sapiens
  ENST00000491483
gctttgtttacctaagcaatcctgggcaatggcgggcgccccttccccagcctcgttgccgccttgcagtttgatctcagactgctgtgctagcaatcagcgcgattccgtgggcgtaggaccctctgagccaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggcc

SEQ ID NO: 9822 - DNA, 1787 bp, Homo sapiens
  ENST00000475972
gccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaagaactgcctttcttctgagtgtccacttgtgtccggaattggtgggttcttgatctcactgacttcaagaatgaagccgcagaccctcgcgccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtc

SEQ ID NO: 9823 - DNA, 1168 bp, Homo sapiens
  ENST00000538666
gtcacaagcagaatcttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcctaa

SEQ ID NO: 9824 - DNA, 1150 bp, Homo sapiens
  ENST00000328087
cttcgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcc

SEQ ID NO: 9825 - DNA, 1168 bp, Homo sapiens; identical to SEQ ID NO: 9823
  ENST00000538666

SEQ ID NO: 9826 - DNA, 1150 bp, Homo sapiens; identical to SEQ ID NO: 9824
  ENST00000328087

SEQ ID NO: 9827 - DNA, 2641 bp, Homo sapiens
  ENST00000381434
agaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgta

SEQ ID NO: 9828 - DNA, 636 bp, Homo sapiens
  ENST00000463336
aaatgaagcctaaaatgaagtattcaaccaacaaaatttccacagcaaagtggaagaacacagcaagcaaagccttgtgtttcaagctgggaagcatgtggtcttaacttgcgactactgatgaagaagagaataacagatgaagatatttgaataatcatcttagtcaatttgtgttaccatagaaatatacctgaagctgggtaatttaaccctttttccatttagaaaaaaaagtgcagcttgctgccagcgcttatttaattttacataaacatctctttgaggctgaagcaaatctgattttcaatgcaaaaatagaatacaaaaactgttcttggagttatttctaaacagaactaccatcagcattgtctatttcagaaaaaatgagattcaccaaatgaaacttcagcaagcaactaactgttcaagaagtgttcaagaatgttaacatcacatgtaggaatgctacattttccaggatttgacattttcagcgatcaagaattactatattttatcaatgaaaataccactactaaaaacataaatagaatgatgtcttttgtttccaaagttgatatactagagagatgtaaaaataataataaaagcaagatctttcgtggcaaa

SEQ ID NO: 9829 - DNA, 2327 bp, Homo sapiens
  ENST00000417746
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgt

SEQ ID NO: 9830 - DNA, 757 bp, Homo sapiens
  ENST00000611532
acagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaag

SEQ ID NO: 9831 - DNA, 2501 bp, Homo sapiens
  ENST00000456383
atgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgt

SEQ ID NO: 9832 - DNA, 562 bp, Homo sapiens
  ENST00000414590
tgagtgtctgaagttcatcatgccacatttcccagtgtaaagaagttcagaactaaatggaatgatttaaattcttgacttaaggagaccagcagctttgataatgctgccaaattatcctcacagtatcagaaagaaaaaattgacctaaagacttgcgctgtaagaattaaaacagcagaagcagaagctaccctcacctccccatcacttgtctgccctgaagcaggacataagaccctcatttgagaggtgcccttccttatctctgaagacaaaggaacattcttatctctgaagacataggaacatcgagaagaatggagtatgcttatctatgaagacatgagaacacagagaagaatctgaacaaacggggcttgctaagttccctgcagtttatcggcattagattatacaattttgtcctccctttgtatttctctatgactgtccatgattcatcaaacctaaacataataatatacaagtctacttgtttctttgggtcttcatttccaaagcctcccatgttcataaatatattaaataaatgtatatg

SEQ ID NO: 9833 - DNA, 704 bp, Homo sapiens
  ENST00000614979
gaaagaggagaaagcagtaatgcatatagaaaagaatgagaaggaatttaaaagggaaataacatcatctcattatattttgaatgtggaccatttcacccacaaacttcactcagtcttttccggttttgtgcttcacttgccgttaattgtttctgccatcccagttctgccattctaggacatgggggatgtggaacatacagcatttggcctgactagactgccactatggctgctttcaagagattagagatactgctttctcaggaaggagtacttcctattcccacccttgcctaaatgatagattttgcctaaatcccaaagctagatctctggattttatcgtttgtgtagatagcaaaaatggccacgaactctttccttctcatcaagaggtgccatcttttttccaaccccttgaatctggagttggctatgtgatttgatttagccagtagcccaacaaatgtgacacaagcagagacttgaaaagttcttgtgcatggggcttgtcctcttttgctgctcttgggaaccttgcaactaccatcaggtgaacaagcctggactatcctgctgcatgacaaaagaaaagggcccagttacccttgtcaccctatctgacagcccgtcaacttccagctgatgcagacatgggaaaggagaactacttggattccttgagtgtctgaagttca

SEQ ID NO: 9834 - DNA, 13140 bp, Homo sapiens
  ENST00000271417
gttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatccccatcactttacagtcactagtcaatgactgttgttacactaaaatcaaaaggcctttggtgagctcagtgacagtgacctctgggacaatcacagaaatgacttcactgctgttctgaatgacaattcttaagtggctaggacaaagcaaaagcgagtatacctttttgaaaagctgtctaagtggtatttccttttccattctgagaacgtaaactgctttttccttttctgctgcacatgtcaatatcggagtcttagacattaagggctcttctcttcctcccctctcctggacttcccacaggttggtgccacacacacagccctgcctccctctgcactctgattagattgtcattgaatgccttgtgataaatgcttaaaatatacacatgaaagagaagagggaggaaagaggagaaagcagtaatgcatatagaaaagaatgagaaggaatttaaaagggaaataacatcatctcattatattttgaatgtggaccatttcacccacaaacttcactcagtcttttccggttttgtgcttcacttgccgttaattgtttctgccatcccagttctgccattctaggacatgggggatgtggaacatacagcatttggcctgactagactgccactatggctgctttcaagagattagagatactgctttctcaggaaggagtacttcctattcccacccttgcctaaatgatagattttgcctaaatcccaaagctagatctctggattttatcgtttgtgtagatagcaaaaatggccacgaactctttccttctcatcaagaggtgccatcttttttccaaccccttgaatctggagttggctatgtgatttgatttagccagtagcccaacaaatgtgacacaagcagagacttgaaaagttcttgtgcatggggcttgtcctcttttgctgctcttgggaaccttgcaactaccatcaggtgaacaagcctggactatcctgctgcatgacaaaagaaaagggcccagttacccttgtcaccctatctgacagcccgtcaacttccagctgatgcagacatgggtgagtccaggtgataccaatagaagaactgcctagctgaacccagcccaaatttctgattcctactcgaggcgtgagaagttggtgcattctttatgttcatttctctttaagaacaaacctgactcgttcttgtctgaatgttcatccctgaacctcttaatccatccaaacttgtgtttctcatagcctccactattgttgacaaatttttatcaaagcttttcaccctgcactcttgtggagtggaggataatgcttgactttgctatcccttaatccagcagtggtttcttccctgtctatggatccgtggacaacctctgaagatctcttctttaccatccttttggtcttctccagagccaccctactggggctagaccctattctcaaagtaccattcctctagtatccatttgtacttcatgacatttccaaaaaaagtcctatgtttgcaatgaaataagaaagtggctgggtgagggtcggagggatgagctggtatgtgtcattgcttggagaattgacctaccaaaggacttccgtgttgctttggccagtcccagagaaatcaggagaacagttgaacccagtgctggcacttccaagggctggaagacacaagccataaccctggtgctgagttttagacttgctggtgtccctggcctctgaaagcctaggtctagcctgtctgtttggaccccagttcagatggaaaagatgataaaaaacatttcttagtcaccagctttggatttcaacttgctcaggcaattttggagaatattgggtagctgtggtagctattatcgctttatactgagcactgtgtcaggcttttcaccaccaaagagcctcatagcaccagctgcagagaccaaaaataatgtttttttaaagctacggacgtatgattttggtgaaggttgagggtagcaatgggaaagaaagaattattaaaattggaaacctgcaattccaaagacaacaaaactacagatagactgaaaagtacaaagaagatagcaggctactgaattaaccttgggagttgggaccaggttgtcctttgtagaactggataaatcattcagacttccaggctttcagtagagagaaaaagcagttgtttctgggtatatggacaggagttaaggctgagttgacaagtcaaaacttcttgtcctcagcacccctgactttcctctatgtgtccttttgtttcttctcctttgaatagtgtgtcctgcacaggaaatggttatatttgttagcttctttcctaggtcttattggagtacaaagtaaatcttgtgtaagacataatctctgtccactaggaccccgtaatttaataggggaaataagacatgctcaagaaaggagattttatacatagagtatgaaatagtgctatggataaattataataaaaccagagatttagtttttttaaaaaatgagaatactttgatattaaagtgttgtatgtgtttgtccatcatcttatttaaacatagacttggtgatctgaaaagccaatactcaaaagtctgaactgaaaagaggtgaattaggatcgggaaagggtgagcagcaggggtcccagggggatgatgcataagctgctgtgcttgcctgtgagtcactactgagtcaggaacacgctggaggagggagtgtggatgcaggtggcagggaggtgtcccctggtagatgagctgcttctctaggccatgcatggattcattaggaagttggagacaatggccatggacctggtgcatggcagctattccatccaagcacgttcacaggggagctcagcgtggctgctcctggggctcagttctgcggctgtgagtgctgctgcccatattcaccaacacagggcaggcctcacggagatgctaggcctcacatcccccttctcatgatcctcactgtgcacttgacataggattaggcatactggagatgagaaaaggctgccacccaaacccaaggcacctgaccacatctgtaaatatttctgaatagtccacaaaatttcacataggtagtctgattagatcttgcctttgagagaagctgaagtcacagatactgttgtaatttaccaccgcccctcacccaattttttttaataggtgaagaaaccatcactgccattaatgaagtcacaaacctattaggtctttagactcccaacctctggatcttttctgctgattagtgtttcccaaaattgcctaaccacaagaattaacttgatagctgctgttaaaaaggtattgttggaccctgttttggagattgattgggtgggtctagagccagaattcatatttttaatatgcattccaggagactcctgtgatcagatgcatttggaaatcattgcactaagtcatacctctgggtactccaaacagctagtcctgaggcttccttgggccttagaattttttcttcaaatgtcctggtgaggtccctctcaatcctttggggctggctgtggtgagtcactcagaagtctggctgtgacctggatgggctcaccagagtacgctagtggtagtgggaaaacaggcagagagaaaggagtgtcaggagcactcccagggaggctgttgtagatatttccattcccagaacagtgatctattgtgacagtctcagaacagacaacaagaattacaggtaattttctcattctcttgatatatttttagcaaaacttaaatcatgaatagaaggaaaagatgccattggggaaatagaaaaactcaatcattttataaagcatacaaatcataaggatgactggccaatagcactcccactttggtcttacctaaagttgggtggacaagaataataaaagtcctcattttatatccttccaaaatcagatttaaatgctgccagcatcttaatggaagtctgaaattgattgataggatgtagaaatccaaattcactaaaatagggggccagctacataaagtcctagaaggaaaaagtgcctcgcttttttctgccattatcctaccccctagtcatctggggaattgatctatgaagcttgaagaaggggcatttaacatcagagtggtgcaagggcagtgttgagatgctttaagcagcagcctgagctttagcactatttgaaggggagaaggttaatactaataatatttgtgttatttttatgatatattactgtttacagaacactttcatttgatcccaacatcaactgctgtgatagaggcagggcagatgttgtggtctcattacatagaatgtaaaactgaggttgaaaaatactaagtgacttgtctgtagtcaaatggtttttaaaattataaagccaggccttctgactgtcttgtctggtgtcctttccaattccttaaatactcatgggactggaatctgggtattccagattccagtttctcttcacagccagacatctggtgagaagagccgtagacttgatgcttgttcatatgtcatggatgtggcgaagccatgaagacagatactgttgctgcttcatccaactaagcaccattcattcctcaaatgctaatctaagagggagttgtagcttcactcaaggagagtttcgttttctttttctttcttttttttttttttgagacagggtcttgctctgtggcccatggtgcagtgcagtgcagtggtgctatcagctcactgcagtctcaaactcctagctcaagcaatcctcctccctcagcctcccaagtaggtaggactacagatatatgccaccacgtccagcaaattttgtttgtttgtagagatggggtcttgctatatttcccaggcttgtctcaaactcctggcctcaagtgatcctcccaccttggctgcctaaagtgctggtattacagacatgagccactgaacccagctgagagcctcactttcatcacctgtgctgtgaggggtaatatatgcttcaggttttctggagaatccttcttgcagagaagtttctgaatgaaacgacagattcatctggattcagaactccaggcagaagctgcttaacagcaaaaatctggcatcttcactacattttaagattttaggtagaactaagagggatcagatatagaggaataaggaatgtgagaaggaaaaagatatagtagtttagctaaatttttcttagagtttcttggtggggctggccatgaagtaactagtctgactcatttcttctgggaaggctaaaagagacacagatagcttctcttttaccttggctttaaggaaaagccattttattaacaaaagtattagacacgactgcataagaaatttgctgtgtgagaataaagaacaagggagtaggagggtgggacagagaagggtgagaagttggcttcgtgagggccacctgtcagttgtctttgtgccttgtgacatcaaaactgaaatgtttgtattactgttgtccatgactttttttttctgtgtcagacatacaaattgaatttggttgtaatgttttaaacgtaataaagaattcttacctacatttgttaccaagaactcataattaacacaactatggttaatcatgatctgacattaaatggcctcagcaagagaaagaatcatatgatacatgtccttctctgattgttgtaagtacagtaatagaggaatacatattgtggggttacagagggggctggtactgacagagcaaaaggtatgcttttacagattgtaataagctagataaattctgttgtcactcttactgctctccacagactgtaacattcagaaggagatgaagggtaggaaaggtggttggataaggtgatggtacctagctcatttccaagaggggcacaagcatatgcctgctagaaattacacttggggaagggaggaaggaagctattcgtgggaggacatttcaagttctgttaagatttgagaaattccacagcaccataattaagaggaggcaattaaaaacctttgttagcaaaagaagtgataaatacctctgagaactattaatcctgttttggatggctaagccctctcaagggaattccagattttagtggccttgtcaagcagaaaatctgtttttgcttgaagcatctgggctcaattttttttaagtagttaacttaaaaatgttaacatgtagatttaacttaaagatagactctaaaacagtttgattacctctggattttgtattattttgtgttttaattccatttaggtttttcagctttataaaatatttttgtttttatttataaagtatttgtttagaatcacccacgtgttttttctacacatctttttttcctatatttcagatcttccttttgaaatattttctttctgaaggaagtttacttcagtaatgatttgttggtaggatactcatcagtctttgttgatgtaaaagtctttatttcattcttgttcttgaaagataatttcactgattatgattctagattgatagttattttctttcaggacattgaagttattattacactcccttctgacttttatttttgcttttaagaagtcaattaccagtttaattatccttcctaatctgtctggtctctctgactgttctaaagatttttttgtctctagtgttctttggtttaattaacatgtgaccaggtgtggatttctttttatttatccaaattaggatttgtggtgtttcctaaatccgtggattggatttcccattaaatatggaaaactctcagctatattaacacatcaaatatttcctcttctttttaaactctctcttgagaattccaattgttagattttttttcattctatgccccatattgtttaatctatattttgtatttcctctctctgtgttttctattccctattcaggtaaatttcttcaggtttatcttccagctcactaattttcttttcagctagctctaatctcctttatttgagttttaattttaattaatatgtatttcatttctaggagtttagttctttttcaaatttacatagtccctgttgtcttgtgacttactctttttttttttttacaatgccctcttatttatctgaatatcttaaagatactaacttaaaattttatatccagtaattccaatatctacagtctttgtgggtctacttttagagtttgttacttctgctaactttcactcacagttttttgtttctttatgggttttatagttttttattttaagctcatgtgtggtgcaatgccatattacattgtgccagtcaagaaaaacctttcttgctccttatctgccttacatttctccataatgactctatatatacacagcaaccctggggaagccaggaagagtgaatgattgagtaaggaagaagtaagtgtgctaaatgggaaaaaatgaaaaaggcacacatacacgcattgtgcatttctttctaatgcaacctgtagactgcaaacaaaatcttaagatggggagggcaagaggctttaactttacatattctttagagtttgataatataagagaatggctgtcttaattatagacatagactgttttagggtttaagagtgaacagaaggctgttaattgttaagagtggccaaataaattatggatgtagatttcattcaagaggcaaggaaggccgggccctgtggctcacacctgaaatcccaacagttagggagacaaaggtgggaggatagcttgagccaggagttcaagacctacctgggcagtatagtgagatcccatcctccacaaaaaggtaaaaatttaaaaagacaagaaaaaaaagaagcagcaaggaaggactagactcataggatggattaaaattaggcaaaacaaataattcatttttccctatgattatctaattctaatccaatttttatatgctttcatttcaagaaataagaagtaggctaatttcaggttctcttagaaaatcttggcagagacatcctaatcatactcatcacaccacttaggtgaaaattatattttctgctgaattggttataagcatttcctgaatacttatcaggtggcctaagatgactcaccaaaaatggcatgaggtgtagaagtagctaggaagttgcttagaggtgagtgagttggtctgacacgccatctagtggcacacatccaagagagtgactctattgctaaccttccagtattggatggaggtgtgcctcacattacttaagggaaaagctacatatgaatttatatagcttattttaatgctatatatgaatttatatagatgaatttggcttttgaaaaacaaattaagtgcattaggaattttttctttaaaagtgatatgtttttcttacactttgcaagtttagaacttgccatattatgtttttgaggcaggcttctgtggatataatgtggggaaaaccatgaggtttttgcttgggatcaagtgggatttaggtgcatgccttttgtgatttaaagctattttaaagtgtgcttttaacaccatggaattacaattgttttctgaagtcaggtcaggactctgattctgcagaattatggtgaagccagtttctctttaacaagcaaaaaccgtgtcatcaaactgtacaaccaaaggacctaaatagtccattccctagtcttcagctgtacaaagatgaatcaatctctctgtctcttgttctctctctcactgtctctaaaaaccaagcagaggagaaaattccagacatgttaaaacactttacttttttttaaaacaatccttgctctctggagatattttctcacattttgttacaaattttgtgtagaagcatagccacagtggattttttctggctctttttctttctctgagacgttaatgtccagtagagcaaagctagaaggatatatatatatatatatatatataaatatatatatttatatatatttatatatatatatatatatatatgtatgtatacacacacacatatatatgtcaatttctattaaccttgtttttggaaaaacgctttgttcaactgaatgtagttaaattataatggacattaatatacaaccccaccctcccagcctctttttgttgctggtatgacttaggcacctagcttttctcattccctcaggccaaggcgatagcctcttatgtttcattcctttggcagctgtattagtaaaaaaatttttggttgcaaatgacaggaagatagctcagactagcttaagaacaagaaaaggagaaatggagctcatctattagagagatcctggagtagctcacaggctggaagagctgtaggaactgagaacaaacctgggtctcaatgtagtaagatttaagattccctgtccatcatccacacctacttgtgtttttacatcaatacattttctcagtgaggatagacttactccaaaaggcaggaatatagccactagcagtctgagagtcacaactttccagctcatttgaccaagcaggcaaaaggctttactcatgagaacaatcctggagaaagactgcagtcaactcatattgagtcatgtgcccatatctgagctaatcatgtggccagagatgtggcaagtctgtttatgaccaggaaggtgagactgcgatggactggatagtgggataggaagatttctccaaagagagaagagagttgttattaatagaagaagtgagaatagtgatgctgggcagacaaaacacatacacaacaccaacagctatctgctactgcatccgaaaagattctttatctgcagccacagagccctgaacaaccagcctttccggcttccttttgttgccaattccctcacacgtattattccaacccaaggcttcagggaggctgtttttaccacagttcagtgacaaatcctaccagagccttccatataccagtgaatgtccttggttatacttgtctcgttctgaatttagaaatccatctctgtgtcactgccttcattaggacctttcgtctcctccctggattcttctggtaccctcatttcttgtctcctacttcctgttgtctcctaattattcaccttctactttttttgttagaggttccagacagtttcaagaaaaatacttaatgctgggcaaggtgcttctcccttcctctctaagttccatagaacaggggacattttgcttctctgttgctatggactgagtgttttgtgtcttccccaaatttttatgtcaaaatcctaatcctaatgtgatggtatttgggcatgaggcctttgggaggtgattaggtcagtagggtggagctcttatgatggaattagtgtccttataagaagagacaggagagagattacttcctctctttctctgccatgtgaggatacagcaaggtatctgtctgcaaaccaggaaaaggaccttcgccaggaactgaatgtattggtgcactgagcttggacttcccagattctagaactgtgagaaataaatttctgatatttaa

SEQ ID NO: 9835 - DNA, 2446 bp, Homo sapiens
  ENST00000528703
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagcctttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9836 - DNA, 2242 bp, Homo sapiens
  ENST00000525740
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9837 - DNA, 1238 bp, Homo sapiens
  ENST00000529387
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9838 - DNA, 1950 bp, Homo sapiens
  ENST00000469934
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9839 - DNA, 2566 bp, Homo sapiens
  ENST00000529071
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9840 - DNA, 2299 bp, Homo sapiens
  ENST00000526687
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 9841 - DNA, 651 bp, Homo sapiens
  ENST00000588752
ggagttggagcccgctctgcgcgctgcgggacggggcacggcggagcagggttgggtccgcctcgagcggggagggtgatgctgcaccacaggggcggggctggaggtaaagcgcggagcggagagggaccaggctcggcactgatttgtgttcagggctagcccagaggggcggggccagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaa

SEQ ID NO: 9842 - DNA, 923 bp, Homo sapiens
  ENST00000589238
cgctctgcgcgctgcgggacggggcacggcggagcagggttgggtccgcctcgagcggggagggtgatgctgcaccacaggggcggggctggagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctgggg

SEQ ID NO: 9843 - DNA, 1534 bp, Homo sapiens
  ENST00000269159
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggccctgtg

SEQ ID NO: 9844 - DNA, 1616 bp, Homo sapiens
  ENST00000590107
gggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagaggtgcgggtgtggcccaggtccccagggcccctccctgggctccctctggccatccttcctttctggcttcagcctctgtgcgcctggtttgctgtttgccctgtgccttaatcatgactggcaaatccaagcctcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaa

SEQ ID NO: 9845 - DNA, 1575 bp, Homo sapiens
  ENST00000383376
cgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtctcctttttctctagtacacatgtgaacccggcacaggaactggatagaaaacctctcggcaaggccacatagtcatgcacagaacagatgtttgcttagcgcctgcccaaggcctcacccttagtgaacttgggacagtccaagagtgtcaaaagcactgccctgaatgctttagatctagtcttttctttgatcctgagaatgcctttggaaggtgtaaacagcggccagctccacagggaccagcctgcagaaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacaggatctcactctgtcacccaggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcacctgaccatatttttaaaatatagagtcgataatgagttatactgggtttttttttttctgtttttttttttctgagatggagtttcactcttgttgcccaggctggagtgcaatggggcgatctcggctcactgcaacctccgcctccctggttcaagtgattttcctcctaagcctcccaagtagctgggattacaggcgcatgccaccatgcccagctaatttttgtatttttagtggagacagggttttgtcatgttggccaggctggtcttgaactcctgacctcaggtgatccacccgcccgggcctcccaaagtattgggattacaggcatgagccaccacacccggcctcaaccccatctcttaaaaaaataaaaagataacctttgctctca

SEQ ID NO: 9846 - DNA, 895 bp, Homo sapiens
  ENST00000590138
ggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaa

SEQ ID NO: 9847 - DNA, 787 bp, Homo sapiens
  ENST00000588927
atgaagccgagcggcgaggaccagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtga

SEQ ID NO: 9848 - DNA, 391 bp, Homo sapiens
  ENST00000588863
ttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacaggtgagctgagcagggatcgcctccattgcagggcttaacatgtcctcttctgtgaggttttgtcttttcaaaagcagcattttttaaggcaggaatatataaacaaacctatagtacactcatagtctcatcagaaagatgatcagatcttgatatttttaaaataaggttttccgtttgtgagaggctcttggagtatgttaggaaatctgcacttgtttaaaaaccagtttg

SEQ ID NO: 9849 - DNA, 885 bp, Homo sapiens
  ENST00000588167
ccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatgggtaggaggttcagttcggggaacaccctgcagcccgaggaggaagaacggaacacggacttgctaaaactcccctgggatttgaggaggaagcctgacgtggaaagagtgggaggggcacatgaacatcagactcagggaagccctgtgaggggcccgcctgcagtagatactcctatagccaggcctctggagatgcgtgggcacctgtgttgcttctgatcagaatccatggaactgacctcatgctgctcaaccagcgaatggtgcaaatacttacagtccttcccgagggggcctggcgtcagacaggtttatcaaagcccagtgaatcctctttgtctcttgccttcccagtagggctgtgctgtgagccctagccatgtgagaccactgacacttaatgtcacgttcagtagaggaggattcaattctctggttgctgcatctcaggtgctcagtagctaggtcagctgggagctgtcatggcacaaggcatttgcgtctggcggaggcctgttggttggtggctcc

SEQ ID NO: 9850 - DNA, 563 bp, Homo sapiens
  ENST00000586230
ccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagagatggggcttcgccatgctgcccaggctggtcttgaagtcctgacctcaaagcgatcggcgcacctcagccttgcaaagtgctgggattacaggcatgaaccaccacgcccagctcatgaatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcaga

SEQ ID NO: 9851 - DNA, 919 bp, Homo sapiens
  ENST00000589374
tcagtagctaggtcagctgggagctgtcatggcacaaggcatttgcgtctggcggaggcctgttggttggtggctccaggccctatattcagcctccagagctttggcagaagtgctgtgcttcatttttcactagggaaaatgcccagccggggtacctggctgaagtcggcttgcacaccacagaaaaggctccactcccgcctgcatctgtcctcccttccctctccccagggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatg

SEQ ID NO: 9852 - DNA, 500 bp, Homo sapiens
  ENST00000625802
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtctcctttttctctagtacacatgtga

SEQ ID NO: 9853 - DNA, 3558 bp, Homo sapiens
  ENST00000369950
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 9854 - DNA, 835 bp, Homo sapiens
  ENST00000369952
gagagacccaacgggacctcagcccagccagcccaggtgaagcctgaattttataggcaagctgagctgaaaccttgcccttggacaggatccaatcaaaggagatgtatcactttctgtccaacacctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactg

SEQ ID NO: 9855 - DNA, 3324 bp, Homo sapiens
  ENST00000611179
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 9856 - DNA, 868 bp, Homo sapiens
  ENST00000369963
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagaaaagaataaaggtaaaaccaaaccattcaatatcttacagtttggaaacaaccatcatgaacatttactgcctattttctgccttctttcttctattatatacacatattactga

SEQ ID NO: 9857 - DNA, 570 bp, Homo sapiens
  ENST00000532631
ggagtgggagtgggccggggccagggccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccc

SEQ ID NO: 9858 - DNA, 708 bp, Homo sapiens
  ENST00000451872
ccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcc

SEQ ID NO: 9859 - DNA, 4298 bp, Homo sapiens
  ENST00000367342
ggggcaaaggggacagcctcgcccctcgagcggctgctcccgcagctcgctcacccctgcgggtacgtcgtcactcccgcgtgcggccccgtcccgactcttggatcggactcttcagtcccttcttgcgtcttcccctctttcctctgggccttggtatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 9860 - DNA, 2197 bp, Homo sapiens
  ENST00000413687
attagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcag

SEQ ID NO: 9861 - DNA, 554 bp, Homo sapiens
  ENST00000531649
agtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaattccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctggagctcagtgcctctgatgacagctccctgtcagatgggctcctcctggaggaagggaaaggaaaggtgaactccaagagagctgatcaaccccagatgtcc

SEQ ID NO: 9862 - DNA, 586 bp, Homo sapiens
  ENST00000526172
aatctgggaggcttcttgaaggaggaaggcataaaatagggctgtgtgggaagaaaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgct

SEQ ID NO: 9863 - DNA, 1241 bp, Homo sapiens
  ENST00000465162
gcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatgatggagtctcgctctgtcgcccaggctggaatgctgtagcaagatttcggctcactgcaacccccgtctcccgggttcaagcgaatctcctgcctcagccttccgagtagctgggattacaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtga

SEQ ID NO: 9864 - DNA, 570 bp, Homo sapiens; identical to SEQ ID NO: 9857
  ENST00000532631

SEQ ID NO: 9865 - DNA, 708 bp, Homo sapiens; identical to SEQ ID NO: 9858
  ENST00000451872

SEQ ID NO: 9866 - DNA, 4298 bp, Homo sapiens; identical to SEQ ID NO: 9859
  ENST00000367342

SEQ ID NO: 9867 - DNA, 2197 bp, Homo sapiens; identical to SEQ ID NO: 9860
  ENST00000413687

SEQ ID NO: 9868 - DNA, 554 bp, Homo sapiens; identical to SEQ ID NO: 9861
  ENST00000531649

SEQ ID NO: 9869 - DNA, 586 bp, Homo sapiens; identical to SEQ ID NO: 9862
  ENST00000526172

SEQ ID NO: 9870 - DNA, 1241 bp, Homo sapiens; identical to SEQ ID NO: 9863
  ENST00000465162

SEQ ID NO: 9871 - DNA, 7578 bp, Homo sapiens
  ENST00000330634
cgccccgcgcccgccaggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccggtgtgcgactgtcgtgttcagaggctgcgggagtgggcggtggacgtgggctcccacaaacatggtgagcgctggacaggccccgtgtgaacactcactgttgaggggcccccaggccccgtgtgaacactcactgttgaggggtccctgggcccccaggcaccgtgtgagcattcactgttgagggtcccccagtcccccaggccaggggctgtccctggagccctcaggaggcagtaagaaacatctagaagagggcagacccagtggtgaaccgcatccaacagtggtgagatgggtgcagctctacaggggcgtaatttacaaaccaccagactccctggttatgtgtgtgctgcggtggtgtttgctctccagcagatcaagtttgtgcaatgatccattttgagaatctctccgtcaccccaagaagtcctctcgcacccatcagtccgaccccttccccgtgctcctccccagccctggcagccactcacctgcactccagacgctccagatgtcatgcatgtctcctggcttccttcggctgttttcacgcgccatcctcacggcaggctgtatcaggacttcattccatttcatggctgaagcacattccattgcatgcagggaccacattttgtttgtctgctcttctgtccatggacatctgggttgcttccagtttggggcttctgtgaatcctgctgctgtggacatttgcgtagtcctcgtgtggatgctgctgtggacgtctgcgtcgtcctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacatctgcgtagtctcgtgtggatgctgctgtgaacgtctgcgtagtctcgtgtggatgctgctgtggacgtctgcgtagtctcgtgtggatgctgctgtgcacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtctcgtgtggatgctgctgtggacgtctgcgtcgtctcgtgtggatgctgctgtggacgtctgcgtcgtctcgtgtggatgctgctgtggacgtctgcgtcgtcctcgtgtggatgctgctgtggacgtctgcgtcgtctcgtgtggatgctgctgtggacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtcctcctgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgatgctgctgtggacgtctgcgtcgtcctcgtgtggatgctgctatggacgtctgcgtagtctcgtgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacgtctgtgtagtctcatgtggatgctgcgagttttcgttgctctggggtagattcgtagcggaggaacaactgggcgacacgctaagtttatgtttaactttttaagtaactgcctaactgttttccaaagcagctgcaccatttttcattcccatccatgctattgtttttcagttaaatagctccactcctccccctccccaccctccacagaactgccagtaaaactggactatggagtattgggtggggtcacctacaaggtcatctgcagcaagtgagaccatcgcccctcctgcctggagaggtgggactggggaccctgtgacaggaggagctgcccttcctggagcctggtttttctttttcctctgtgctccatgagaagtcagtttagtgggctacagccagcaaaggaaccaaaaccaacaggagctctgggggtgccttgcatggcgaggctccgtggctgcacgcgtgtatgcaggtggctgtgggtgtctgtgtgtcctgggccactgtgtgcgatggtcccactgggaggtgtggcccccaaagagtggaacccacaggtggacacacccatgcaccctcgttcttgcccaaggtcacacatcgagacagcagggcccagatggatggccccaagctcggtggctcccgtgctgcccacacctggggacaggcccactgtggggggtaaggggtggaggtgttctaattcgggctgagccgtgtgactggcaggggccccagctgttgggcctgggcaggactgtttttagaaaagccccaactccctgcccctacccgggcccgtggctatttatagtccgggcctggagaagtcagtgagtcactagcgttcgcctctgcagggtcagtccaagcccccttagtgaggtggtctagcatgtcccccagtcccccaagcctctatctgacatctgctagcccagagccccaggggtccccaggaagggctcagagctggtggccccccccaggccttggcagcacctccttgtctgatgggactttgtggttcctggtggacatttaacattgtcggtttctctcatctggaaacaaacctccatgacgctc

SEQ ID NO: 9872 - DNA, 1689 bp, Homo sapiens
  ENST00000398337
aggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaa

SEQ ID NO: 9873 - DNA, 4672 bp, Homo sapiens
  ENST00000392634
gccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacct

SEQ ID NO: 9874 - DNA, 3050 bp, Homo sapiens
  ENST00000252527
ggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaagaacattcctgcccctttttgtcttgtatgacattgacgttctggaagataacttcactttgggtttgcctgattgcgcccccaagcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 9875 - DNA, 947 bp, Homo sapiens
  ENST00000474229
gggtgcctgctgtacgctggacctggacctactgggccccaggcaggacatcctttagaccctctgggaggctccagcccctgcctgctggatcgccaggccccggggctgcgagagcctcactggccgtgtccccacccgacagagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggaggtggggacggggaggggactcagaccggggccgcctgcctggccaccctccggtaccagcctgttgggtggggggttttctagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctg

SEQ ID NO: 9876 - DNA, 581 bp, Homo sapiens
  ENST00000480763
tcacgtctgtcaggcacactgtaggtgtccactcccgtcggtggagggtttgcagcccccaggccctgtcctgtgatccttccggtgctgggctgagcctggggaggagccagggagtgcaggggcactggcaagcaggaccacaccccaccgccagggcatctgggggctccgaaccaagagcccctctccagccctggctgcccctgcaggcctgctcaccagccgccagctgcccatcttctgccagctgatcctgagaattgggaacttcctcaactacgaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccc

SEQ ID NO: 9877 - DNA, 545 bp, Homo sapiens
  ENST00000477497
accaccgtcctcagggcctgtccctgtggccgtcaccctcccgcaactcagggcctcaccccgggtggtgcccgcgcggggctctcacgggactgtcacgtgcccttgcccccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctg

SEQ ID NO: 9878 - DNA, 1102 bp, Homo sapiens
  ENST00000481338
aactgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacct

SEQ ID NO: 9879 - DNA, 2956 bp, Homo sapiens
  ENST00000617571
ggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagtgagctccccatcccacctggtgccaggggctggtgagactcactccctgcccctcccagggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 9880 - DNA, 386 bp, Homo sapiens
  ENST00000416150
gcggccgcgttccggcgtgatccctggaagctgccagcaggtgctgctcaaggaaggaacagcttcagccataggtgacagtggcacacatctcactgaagacagagaaggacaagttgaaaacatggatttttgtgttgtaccatgtcttatgatggtatcattcaacaatttttaaaattagattttggaaaacatttttttatcttctacctcattgtattctttcaaccgccaagtgaagccagtactttaagcctcactgccaatttacagagcacagaataaaacagaagagaataaaatgatatgggttgcagcttcccagttgtaacgagcaaaaggataggagcctcagactcttagttctgaaccctgcctgggtt

SEQ ID NO: 9881 - DNA, 6064 bp, Homo sapiens
  ENST00000242208
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgta

SEQ ID NO: 9882 - DNA, 2403 bp, Homo sapiens
  ENST00000464515
agagaacctttcctatccatctgcagccctgcttggcccttgcctcagtgaatttaccactatcataatcacagtgtgcagagtgtgttaaattaagaacagaatccacagtacgcaatgcacagaaaagcctgccttctgctgcagagaacttgaaactgtgcctaaaatttatagtaccgtaaacatctcagggcctcgagtgataagtatggctggatttccgttaactatagaaatccaggcagggagatcctcccagggagttgcaagttctaagatgaacttcttgaagattgttcccagatttgtgcatgggatacatgtacagcagacagttgtaaggaggtccacggtcatggaaaagaggatatgtttctatatgccaccaagtgggaaaaatggaagtgagggaaaatatttgattaatcaaaaaattttagtttggatacctgctttcatagtaattgttgctgtgtcattaaacatacagttgcttaggaaaagagaaggaaataggtgactttctaattttagagttaggctggaactgagtggttgctaaattcaactgccctgacaatgtggggatttcctgtccattagcagcgattgctatttgacatatgtttctggtgcccattaatctgccctgtaatgggtcagaggcaaaaatgggggattcagaggtactaggtggctctcttaatttaatagaactcaatgctaaggacgcctctatttgttaataagtaatcaagtcattggctactttctgctaaacactagactatgatagtgaccttagaccccgggcattctaaaccaggctggcaggagggtggtggtggaggtgatgtgaggtaagcctcctagaggaactgtcatccaaacaatctgaaaattgaaacattattaaaggcagcactaagggtggtatgttggagttggggcaggagcacttaaggcagaaggaacagcaggtgtcactgcctgcagttgagaaagggggtggaattctcaaggccttagaccccagagaacaggactgggcaagagctgacattcaagggaggaacagcatgtacagagcccaaagtcccagccactttctgttggatactgagcaataggaattcagtaaaggactttcaagaagaagtgatgtgatcagatccacctgtgggaaagatgcctttagctgcttcatggagaaatgactggagaggaggccttccttagtgttgcagaggcaaagtaaagaaaatgctgctgcagtgacccagcaaagaggtgatggcggaggaatcaggctgtgacaagggaagaagaggctggctcaagtgtgtctcgactgcacagacttacacagcgaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaa

SEQ ID NO: 9883 - DNA, 1632 bp, Homo sapiens
  ENST00000442711
ctccctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaaca

SEQ ID NO: 9884 - DNA, 2002 bp, Homo sapiens
  ENST00000638023
gggttcgctagtggctgctcctcgaggcgagaacagagccatgcaaatgctccagcgtggagttgggtttgtgaagtcgccagtaaatcaggccgcctccactaggtgaataacgcggtggcagcgggccactttgctagtgcagtcgctggaggaccgcgctccgcactcagaagggggcagttggctggtgcgcgagcgctcccggctcgcctctgtccgcggggagccagccggcccctccgcagctgccaaaaggggggaaaaaatcaagagctgctcttaaaagaagttgcccttgctggtgctcagggtaaaaatagaggctgccgcttagaccggcttggccctggctccaggcatcctgcgagctgggctcgagcagcggccgcgttccggcgtgatccctggaagctgccagcaggtgctgctcaagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatg

SEQ ID NO: 9885 - DNA, 1919 bp, Homo sapiens
  ENST00000322522
ctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagga

SEQ ID NO: 9886 - DNA, 552 bp, Homo sapiens
  ENST00000430311
agccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctg

SEQ ID NO: 9887 - DNA, 613 bp, Homo sapiens
  ENST00000413239
gcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacaggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggg

SEQ ID NO: 9888 - DNA, 812 bp, Homo sapiens
  ENST00000431594
cgtttctcgagggaaaggctgctgcctcctgctctgtcctcatccccggcttagggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcag

SEQ ID NO: 9889 - DNA, 797 bp, Homo sapiens
  ENST00000444194
gggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctctccgcgggtagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacat

SEQ ID NO: 9890 - DNA, 454 bp, Homo sapiens
  ENST00000422454
tgcctcctgctctgtcctcatccccggcttagggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactgggcctcttccctcacttctgtcaagggctgaaaccagattaa

SEQ ID NO: 9891 - DNA, 480 bp, Homo sapiens
  ENST00000417336
tgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaaggggaaaagattaccttgaggttgtgttcaacagagg

SEQ ID NO: 9892 - DNA, 626 bp, Homo sapiens
  ENST00000458647
tgtcctcatccccggcttaggtaacacgttttcctccttacgacacccaccacagggtccccgcgccgctgcccctcctccttggatctggggcccgggctggtgagcggcgcgcgccgtcgcctctccgcggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgtt

SEQ ID NO: 9893 - DNA, 840 bp, Homo sapiens
  ENST00000423767
gtgagtcgatggcgccgggagggttcctcgcctctgcgcgccggcctgcgaggtccctgccccggcagcgaggccgcccccggccgggcccggccaggcatgcccggcatcgccgctgcagccagcgcggaggggagctcctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacacc

SEQ ID NO: 9894 - DNA, 425 bp, Homo sapiens
  ENST00000451089
gggcccggccaggcatgcccggcatcgccgctgcagccagcgcggaggggagctcaaattgcttaaaagataattatgttatataaagtgatcaatgaaaacaaacgtcatcttcattttttaaagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagc

SEQ ID NO: 9895 - DNA, 631 bp, Homo sapiens
  ENST00000409027
agattactgcagcatttgtgctgaaactcaccagggttaaattgatgagctttctgcgtgaaagaagggagtggtggtgatttccggagcttgtagccaggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatag

SEQ ID NO: 9896 - DNA, 541 bp, Homo sapiens
  ENST00000458193
gctgaaactcaccagggttaaattgatgagctttctgcgtgaaagaagggagtggtggtgatttccggagcttgtagccagggtgattagctcgcctgagtgttattagggtgttataaggagtgtttcttggttattcaacagtgtagttagtatcgtttcttttaagaaaaaaaattgattttaacacttgaataaaagaaacactgctgatattgtttatcttgaaagctttcaaatcggactccttgagatcttcacgctactgttaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaag

SEQ ID NO: 9897 - DNA, 670 bp, Homo sapiens
  ENST00000487628
cacattcttgtatttttccagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggtaagtataagaatcttaatgtgtctttgtaatttaattatcatatggtattctagtctctagtttataccatgaactaaatgtttggaagccacttactgtaaacaacataatatatttgaatgttaaggttcattcaatttctacctcagaatatcatgccatttaacttaagtagagagatgtggtatcttagaataatttagcaagtccatgtatcattttagatataaatctgtggcatttaagtaacttataactcaagctttgggaaaattgcatggccctttgggaatctaatgtaagttattaatgcccca

SEQ ID NO: 9898 - DNA, 832 bp, Homo sapiens
  ENST00000470892
ttaaaatgtacagttaagttcttattgattatagttaccctattgtgctatcaaatagtaggtctttttttttcacccattggaaggaggcttttccatctcacattgtactagtcctctgattagtagtatttctaaaataatcccaccaattattctggttattactttttcaatgcttttgataagtaacaaatatttgaatgcctgttatatacaaattgctatgccacaggaactatagacacatcctctcccttcaagagttctcacagtcaggaaaatgaaacacaagcaatttaaaagtaaagtacaagaggccaaataacaattcaatacagtgacatccaaaggtaaaaaattattggttaccaaatcagtagaagagagaagtcatatggaacagagtcttctaaatgatctttacctgaatccaaacacatttgtttcctttttcagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtg

SEQ ID NO: 9899 - DNA, 2162 bp, Homo sapiens
  ENST00000392329
gaatggaggaggaagatttaaaagtgaattcgtgggcggcgacaaggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagg

SEQ ID NO: 9900 - DNA, 8831 bp, Homo sapiens
  ENST00000513000
cacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaaggctttacaggaggcatagtactggaaatctgctcctgatgaggtctcagaaagcttccactcgtggtggaaggcaaaggaggagcaggcacatcacatgagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaattacaaataaaataaaaatgaacaacattttgatacccaaaatgaaaattcccatcagcctgaactttatgttgtgaagttcatgaatgtcagtgaggtatctctgagatgtttcttagcagtcatcctggtgtaagcatgcagttatggcataggtttgtgtgtgttaataagcctttaaaacatatgcaaccacaacaaatgataaagtaaaacaattattttctgttgccctgaatatcaaacttgcccttgcccttactcagcaaaataacatttataagttttccaaaatcccaaagtagaagtttccttaaaaaaatcatcttgtataataccagtattcaaacatgggtaaggttaatcacccccaatcactcaggagatagttgcagaatttgaattacaatctcttcttactttcctagcctgtggcttgtcacttctccaaattgccatgctaaatatgcatgaaaattgagggagaatgctagttaaaaagaaattaggatttatcactggaattgaaactaagagtacaaaagtctgaacgaatgaaacttttctccaaattttacaaattcttgttcctttctcattagaagagcatgctatccaaagcataaatctcccttgaaaataacagaggcttcttaagccctctcttagctatgatcaatggatgatattatgcttcccatagctaatgtgatagctccttgcctaggattcctgttgaaataaggattctagccccatgttaagtttttcaaattactacaaattttagataagcatttggagctttttatactagaattatcaattttttattttagctaattacctgtgggcattatacttgaggcaggtaccaaactacttacagcctttttaatgaaaatgtgctgtgtactttgaatccattcatagacaaaattaccttgatgttctcttaactcattctttattttagtgattaaatacaacctttgagttgttcaatatcatttgaaaatggtaggatttgtggttattttcattaccctattagatttaagataggctgggatgacagaggcctccttgaatagctatgaagcctcattcagcatatcaaatggtagtctgagttctaagaaaccttaagtaatttatcattctgtaaatactcttataagcaataatttttatttgtatttttgaaaacaaactacttaaatatggaaaaatattaactggaaagccagcagtagggttttctatttttaaaagacatttcaaggatttcctgtaatcccagcactttgggagccaaggtggatagatcacctgaggtcaggaattggagatcagcctggccaacatggtgaaaccccatctctactaaagatacaaaaattagctggatgtggtggcacacacgtgtaatcccagctacttgggaggctgaggcaagagaatcgcttgaaccccggaggcggaggttgcagtgagctgagatcatgccattgcactccagcctgggtgaaaagagcgaaactccatctttaaataagtaaataaatgaataatatagaagtctcaaattatagtgcttactgtaatacaaatgcttatgaattttcattcattaccatagtcatctgcatttccttatagaaagcctgtactggtgcaaacttctaaaagtggatttcatcaagaaaatgtgtttcatagagacaacaatattgcttttttcctgagaggcagttcattcttaaacaaccacttcactatttcttaagttattaaggctaaatcaaagagcaaatgttaaagtgtttaaatctctcttgaacaaacacagccacagtcatgctattctatctatattttcacttaaaagatacaccagcagacctattttaggaggtcatattgagccaaaaaatgaactgagcaaatgacatttccaaactctttttttgctcaaaaataatatgttcccctttgatattaaatgcagatatcaattctggattagctatttactgagccctaggaaaaacatatttaaagacaaggaaaccattcatttacatctcatatcattgctttttgcttttaaatatcgccttgaggtttgtctacactctgccaaaacaatccctgaacataagtttggtcagcctcataattcagtgagtcgagcaaccatttgttccaagtgataaattgtactaaatgacaaactgcccaatcagggcagagctccatggacccagcctccagcccttattttataagactaacccctcttctgaaaaactctgaaggcttaaaagctagcatttggatggaggatacttcctttttatccttcagctatgtatggcactttacataaaataagaggtaaaaaaggagagaaactgatgtgtataaagtaatgcctttcttcccaagcaaatcaaacctctccctatgtaaaagttgatagtgtaccaagagacacaataccactggtgggctggaactagctcgttctgatgcataaaagttgataattaaagtaccagaaattttgtaagctagttgttaaacattaccattattaaatatgaaattataaaacacagtggaatacattaaaaaccaatgtaataatcaaaacataccacttcccaattattttactaccttatactatttattagtactcttgagtctatttaggtctattacatctttacagtgaaaacaggatacaatattgtgctactgtgggtctcttcctgactgcagattcagtaacatggtgttcgtagcttgaaactgtccacagtgggagtatttaacaccatagaaactggctggcaaatgctacaaactagcaattttaattcctggaaaggcaattgttgagcatttaccagcacacaatgaatgccatattcttttttttttattaggaaataaattattggaggcagtataaaattatttaaaaagtatcaaatgcaatcccttatcttcagatggctataattttggttatataaatgttttggtttttaccttctttaaagactcctattaggttaaaagtcatatttgatgactatattttattcataattaaattattaaatcaccttttctcctgataatgctttgccagagaattcttagcaattcaactgtagtctaagcaataactcagggctaaattcagggaactgttagcccaatcagatatcactaaaaatgtacttcaccatctattttggagtttataattttggcatttgctaaaagtaggaaaaacagtaacatattactgtgcccagattctaataaatatagctcaattgaaaccaaaactgttacattaaacaaattacactctggcactatgctaaatcaccacagatgttttaggtgtttgatttccaagcaggatggtatatcatttgtttggttcaatatatgaggcaccatttgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccaaaaagaatgatttggtgagagatgtgtagctgattgacaattttagtgtgaattcatattcatttaacccagcagcaatctacataagctatgctttttcccacctgtatttatgtttcttagcttataaagtcccaatatattatatcttttgttgctttggcagttttaatttagagctctgcgttcacagagatgccacctatagcaaaaactatctttaagaattggaaaataaaatgaatgttttagataaaatattgcaagccattatgtgtagagttaatgtatggaaatttgcatttgtttttctgaatcatggtgtacattaatcactcattgaattctatttctaagcaaataagagaatcaaacatttctaaaaggaacatatgtcttgctattaataacaaggagacaggaaaaatagtaaggtaatataagcaaaaaaaaaaatgtaatgaatttagctatcctaaattggaatttttacagattgcatgcatacttagaattttaaatttttaaaagatttacaattgagtatggtacccacagagagtgagtaccaagggaaggaagacctaatacaagtgatgttgcctgataaatcacatcttgccaaaaaaaatatattttagtaaatacagttctttaggaagaaaaatgttgccctttcacactcacagtgtaaatacattcataatattccttcaatcatctaaattaccgccaggtcatgaaaggacgcgatcaatgatgacctattgcactcacaggtaacattgactcaaattttggcaatattgctatattatctagataattcttgtgatgtttttatgtcactatcaacattaaaaatattttgttaaacaactatgaaactttcaaaagtttgcatataactgtatgggcactctcatttcactgcatacatacaatactttgtatacacatacttctcgtgtggatattttataattttatttaatctaacatttaacttttaggtttttgtggtactcatctgaaaggttggcatttgttttctttttatgttatatatgtattttagatgaatcaataatgtgtattcctagaaattttttctaggcataaatagatcattttatgttggcatttaagagatatcatttttgttttattgttctgtgtaaaccatattcattgtacactgtgtgtatatttttgtttaaataaatgatttttatttttta

SEQ ID NO: 9901 - DNA, 3165 bp, Homo sapiens
  ENST00000508116
cccaagaggggtcttactcatccttttccattttggagaggttctgctgactctacattaagcccagacagggtggtgtcctgctttgctcctttctgctctctgcgttcctctgctgccttgatggattctgatgtggttgctcagatgatcagcctgcaggagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaataca

SEQ ID NO: 9902 - DNA, 4334 bp, Homo sapiens
  ENST00000509777
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagcagacaaacccagggagcactgaatgaatccgatgatcctgaaacaggctgtctaactgataacaagccaacttctcgacacttctatcctgtcgccttgctgcttgtcagctcacacctgctagttgtgtggcttattttaagtctggcgttactcttagccaaataccaataagttttatgttgtattcctttttcttttctacaaatgacaatgaactttaaattatggggacaatgctgtaatatttttacattttcaaattcacagaatttaaaaaatgttaaattgtgtttagtttgtttttcctaaaatctaaaaaacaaaaagtactatgcattaggtggattattttgctcttttgttcatggaaaggtgtttcccactgttaactagctcaagaagaatttttaaattactgtctttggaataagacaaagaacagaatcctgaaagcttgaagttctgaacctcctgtcctcatcccactaaatttattaaagaaattaagactgaaatttgcacaaacactgaaaccctgagacaagttctagagatgtgggaggttgcagactttatttccactgtgctaatatcatagatgccatctgctgatagaaattttttttaacctgttttacttctttgctgcaattaactcttttctgtcaagtaactttatggagagaatggctatttatgttttgtaattaaattacctgtttgtatctcttgtttgggttgatttggctttcagaggacttttctattctttttaacaaggtcttgtttgtgtcttgatgtaccattcccagcacttgtgacttttgtactgtccgtggacaagcactcttcctttataaagctgagacttggcccaggctgttcagaaagccattttctctcttccttgcacagctaaaataataaaatagagatgaaatttttctttaaaaatctatagggccagacttaataaattaaatgccttatttctagaacctgcatccttagggctacatatagattttaatgtgttttaaagagactgagaaattaatttgtggaaatgttataaaaaggcagatatatttatgaaactaaagtggagctgtattgtggagcaaattatatttaaagagtttattaaattttaaatgttaagagtaaagagacttaagtcatctctttcagagggcaataatggtattgggcctggcctaggatttaattttgtaagatgtatcatcacttgtggaaaaaaaaaatgtagagttgaatctttgttatttttacttggatggttgctgcaactctgcattaaacaaataaagcatatttattta

SEQ ID NO: 9903 - DNA, 2265 bp, Homo sapiens
  ENST00000511838
atatctggaatacaaagttgttgctgccagtgatttgaggaattctaataagaggaacaacagcattgcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatcc

SEQ ID NO: 9904 - DNA, 2953 bp, Homo sapiens
  ENST00000512630
aaaggataaattaaagtcgagatggacctgaggaagaccacatgagggctgatggggaagaggcatttgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattattctactactcacgaaagattggctggcctcccagtataccagtctagtaagtctgcacataatggcatgaaatcaaaagacataaattcaattgaaagctcacttagatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacac

SEQ ID NO: 9905 - DNA, 2855 bp, Homo sapiens
  ENST00000510812
ggatgtttcctgccctcgaacatcagaatccatgtttttcagcttttgggctcttggacttacaccagtggtttgccagggccccccagccttcgaccacagattgaaggctacactgttggcctccctacttttgaggttttggaacttggactggcttccttgctcctcagtttgcagacagcctattgtggaacttcaccttgtgatcgtagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaa

SEQ ID NO: 9906 - DNA, 2155 bp, Homo sapiens
  ENST00000514525
atatgcagagaaaattatagttagtgaaacaactctgggtgctgtattttacctcttgttattttctagcctgttggtctcttttcttttagggaaaatgatacattttcaccctttaatcctaccccatgagcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatcc

SEQ ID NO: 9907 - DNA, 719 bp, Homo sapiens
  ENST00000506297
gagtatcccatctatgaggagaccaaaataaaactaacagtctatgatgtcaaggataagtctcatgacaccttcaggatcaacagattaacttcactgtgaattttttgacccctgaggcaagtgttcaaaccagtattgacttggcttcttccaaccttcattttatgtgtcagctgtgatgcaatacttcaagtgcttcataaagataagggctgcacttttccctcagagcactggccaaataataatcaggttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcag

SEQ ID NO: 9908 - DNA, 570 bp, Homo sapiens
  ENST00000507462
aatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaag

SEQ ID NO: 9909 - DNA, 673 bp, Homo sapiens
  ENST00000506217
atggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggtaacttaatgagacacaacagttttcttgtgaaatagctggacatgcagagaggtcacatgaataataagctcacacctgtgttcccgccacccggatattattcaaagcacaaaacatcataaataaagtcaaggtcctctata

SEQ ID NO: 9910 - DNA, 563 bp, Homo sapiens
  ENST00000506788
aaagcgcagatggggagagtcatttgccccacaccctacacagcccggaataaccaggaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtg

SEQ ID NO: 9911 - DNA, 548 bp, Homo sapiens
  ENST00000506517
aaattaaagtcgagatggacctgaggaagaccacatgagggctgatggggaagaggcatttgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgctgcagctatctgaataatgggatcaggcctggtgattggatgctgctgaacatctacatgcaaggatctcgtggctcctgtccgtgatcgtaaactgaatacactggtgcagatctccgtaatccaccccgtggagcagagtctgacaagatactc

SEQ ID NO: 9912 - DNA, 526 bp, Homo sapiens
  ENST00000506000
agtcgagatggacctgaggaagaccacatgagggctgatggggaagaggcatttgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttggaaattaacttcatattcactctgtaagccaccacttgtagaaggtctgttttttttctatggaagcggatgattgtaaaaagtgtcatgtggatatgcaattcagtatacatctgtaccagcatgcaaggatctcgtggct

SEQ ID NO: 9913 - DNA, 523 bp, Homo sapiens
  ENST00000504632
aaattaaagtcgagatggacctgaggaagaccacatgagggctgatggggaagaggcatttgaagctatttgccagtttataattctgtctcctcaaagagtagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgctgcagctatctgaataatgggatcaggcctggtgattggatgctgctgaacatctagaaattaacttcatattcactctgtaagccaccacttg

SEQ ID NO: 9914 - DNA, 558 bp, Homo sapiens
  ENST00000506243
aaagaaaggataaattaaagtcgagatggacctgaggaagaccacatgagggctgatggggaagaggcatttgaaggctttacaggaggcatagtactggaaatctgctcctgatgaggtctcagaaagcttccactcgtggtggaaggcaaaggaggagcaggcacatcacatgagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgctgcagctatctgaataatgggatcaggcctggtgattggatgctgctgaacatcta

SEQ ID NO: 9915 - DNA, 1506 bp, Homo sapiens
  ENST00000507861
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattagcagctgcaagaatttattcataataatgttctaccagtataaaaaacttcaatttctttttttatatatatttttaaaatatactaagaaacaacaacagataattttatcttgtcaaatggcaagaaatgcttgatgagcgaacacaagtttactaaaaaaatattatttcaagtcatcatggaactgtattgttgatcctagaagacacagtccccaaactgttaggttccttagcactttaagatcttcaactacaccatttcttgaagaattttttaaaaactactctttcaagggtattacagataaacccgtggatgttttactgtccatttttgtcatttttttctttgagattttttaattccacaaatcctccgacgtcacctattattgtatgagtaacttctattcatttcccaatgaaagaataatagcttcttaaatatttttatcatgtttaagggtgtgcatatttatttaatcagaagtaaaacaagaacaaattctaggaaaaagaaattcagtaaggaagagggctttttcgtctaattttaactaaatctttgatatttgattctctactcttaaccaaagtattcaaattatttaggaatttcaatgaccttgctttctaaattaggaaaacagccacaccaatcaatttgctaggtgccatattgctttgtataagttattttccatcaaggatttgtgtctgctttgtgtgctgctatataataattatgtcttgctgaagttcttctgcttattgaattcctctactgaagttccttacttattcaaataagtaaggtaggaggtacttagtcaattgagcagctaattggctaaaagtgtcttgagcacaagataagcatgtactgaaaaactgagtatctcttgtccattgttaactgtatttctaatggttgattgcatttaaattaaataattcacccctacaa

SEQ ID NO: 9916 - DNA, 583 bp, Homo sapiens
  ENST00000503927
gcgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagggggcgctgttttggggaaatggcagaactccctcagaggctgatctaagggttcccggcagaaggggccatcttcagaggctctggttgcatgactgtttggagtttgatggcctgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccg

SEQ ID NO: 9917 - DNA, 434 bp, Homo sapiens
  ENST00000514964
tcatctctggatcctctggggttaaaaatccatggacacaatctctaaatcctattccagttccagcctcctatggtcttagaatacaaagaaatggtgttacctggcaagaggtcttctgtcttttatgaaaaattagacaaagggggcgctgttttggggaaatggcagaactccctcagaggctgatctaagggttcccggcagaaggggccatcttcagaggctctggttgcatgactgtttggagtttgatggcctgaagatggaagaagctattcagggaaggagtgacttccagctttgaaacaagaactttagaaacttcagaagcatacggaaaaggaaacaagaaaaatgtaatcaagcaagcctcttgaaatgatacaataatataatagcagaattagatccacagaatttatacaattaaa

SEQ ID NO: 9918 - DNA, 341 bp, Homo sapiens
  ENST00000505483
caaccacagatgcacaggagctgagaattctcccaagccaaatacctgcatccaagatcttgtcatgttctattttggagaaacccaaatgaagatgtattcttccttgagtaatttcagatgctggtgtcatctctggatcctctggggttaaaaatccatggacacaatctctaaatcctattccagttccagcctcctatggtcttagagagaaaaatctcattaagtgagaatctaatgggctggaaaaattcaacagactaacctcagatgaagtaatatatttattgaaaaaaatagcaccttgttagctggaaaataatgatacattgacttac

SEQ ID NO: 9919 - DNA, 238 bp, Homo sapiens
  ENST00000512489
atgcacaagtatcagtctgcctgttcaggccttctctaaagtgcaggaagtcactagatctttctaatgtcctggcacagaagtgaagtggatttaacattctcagggcaaccctcaaccacagatgcacaggagctgtaatttcagatgctggtgtcatctctggatcctctggggttaaaaatccatggacacaatctctaaatcctattccagttccagcctcctatggtcttag

SEQ ID NO: 9920 - DNA, 585 bp, Homo sapiens
  ENST00000508084
ataaatagcaggttacagctcctcctgggcgcgcacacgctcacacgctcgcaagcgaacgcaggaaagtcaggctaaaagtgtctgctgctgctgccgccccccactccgcctccgggagagcctcgtgaagggaatcctgttaaaattcattttacaaactgaaaaacagctttaaaaaggaaaagttatcagcccaaggacattaagaggaacttacaacagcactatctctttgctttatttttgttacctatttcagaaaaacaacaacaacaaaaaactataaaatatgcataaggtatacaaagtgaaaatatggcagtttctgacacacccaccactcaggttaagaaagagaacaattgcctttgaagcttctccagtgcccatccggttggcatctgtctgttcttcctaagacataaatactattttgaagtttgtggctacagtttccttgctttttctttagagtttatctgtatttctttatcctaaagaatatcttttttggtttttcatgcatttaaagttatataaatgaaatcattatgtttgtcaaattcttctataacttgcatt

SEQ ID NO: 9921 - DNA, 3741 bp, Homo sapiens
  ENST00000262992
gacttctttccattttgttttttgcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaatt

SEQ ID NO: 9922 - DNA, 354 bp, Homo sapiens
  ENST00000630044
agagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattag

SEQ ID NO: 9923 - DNA, 2967 bp, Homo sapiens
  ENST00000368594
ggaactttcccagcggatctaatggctgcgcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaata

SEQ ID NO: 9924 - DNA, 1432 bp, Homo sapiens
  ENST00000368593
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtggggg

SEQ ID NO: 9925 - DNA, 416 bp, Homo sapiens
  ENST00000423490
gtcacggccaacgtgggctcgctcttcgacgacccagaaaacctgcagaagaactggcttcgggaattttaccaggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacag

SEQ ID NO: 9926 - DNA, 832 bp, Homo sapiens
  ENST00000342652
gcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgg

SEQ ID NO: 9927 - DNA, 870 bp, Homo sapiens
  ENST00000487614
gcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggaggtaggcgctggcttccctcccgccctggtctcatgccttgctctgtgttgaggaaaacagtggaaggagcgtggccccttactggcactttcaatgccatccgcctcccgggatgcactttttaaggcaaaacctttcaatgaagaagcatgttttgctgtcggcagagggatccgtgttggaatccggggtgcgcgggccctcaaggttgccccggatggcgggtgacagtgctgtggggctttgccctgtggcttccgccgtcggcacacaaggagctgctggagtgccgtcacagcgccaccccctcgatgcccacagagctgcagcctctgcagagtgtcagctccttcacactgtccaacttgatctcagcgattttttgtcataacacgtagaaactgtcagagcccgttttaaacattgtgcttttctgtctgcaaa

SEQ ID NO: 9928 - DNA, 565 bp, Homo sapiens
  ENST00000498337
tggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgcgccagtgtctctgcaggagtggcgtgagcggcggccgggacagctcctgacagatgggcaggatcagccgctgccttgtcattgtccacacggccctgcctgccttcactttgtaatcaagaagaatgtgggagaccatgcgaaattggtgatcatgtttgtgaaaaatctcagagagatacaaattatcaattcaaca

SEQ ID NO: 9929 - DNA, 610 bp, Homo sapiens
  ENST00000445580
ctggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagg

SEQ ID NO: 9930 - DNA, 5274 bp, Homo sapiens
  ENST00000629761
ctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 9931 - DNA, 2545 bp, Homo sapiens
  ENST00000630338
ggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggtaaagggtcttggggttgaaaaggtgagattaataccccagggaggaggattgagttagccagtcctgagggctcaggaggaagaggggagcactgcccattgtgtgttcactgggcaacagcaagcaggtacgcatgggttgggggtgggagcctcagcccctgccctttccaggaagccatctcccactgccagattttgatttgaggaataaagatttcaaattatgcactcatcagcaaaacttatttgtgccaaataagggggtaagcagggcctgttcccatcatttcttatcagaaactgaaaggaaagaaaaagaggagatgcctaaactcttgatcctgcctcttgtcccaggaggagcaggatgaaggtgccccccaacccccgcacctgctcatggcctggcaggaggccaaggtcgtgttgcccattaagcaaatgtctgtgtaacaaaaggtgtcatcaataaagttttaacaagttttttaaaaaagcaaaagctgtatctcagaagaaaatacctgcaacaaagcttagggacaaaggattacagacgaagtattcatgtttatattattatttttatttgagacatggtcttgctttgtcgcccaggctggcgtgcagtggcacaatcacagctcactgcatcctcaaacatcggggctcaagcgatccaccccacctgagcctcccatgtattaaaactgcaatacttttgcaccagctaatagctggggattacaggtgcatgccaccatgccagtctccttttaaaattttttgtagagacagatctcactgtgttgcccaggttggtttcaaacttctggccatcttcctgccccagccttctgaagtgctgggattacaggtgggagccaccatgcctggccatttttaaaaaaattcctacaaataattaagtaaaaacaatccagtttttagaatgcggaaaggctataaacaaggcggttcactgaagagggacagggaatagccagtatagatatgaaaaggcgttcaacctcaccttgttagtaactgggaaatgacatttgacactaggcagcctcttcttgcctattagatggacaaagagttgatgctcaagttgatggttgagtcaggacttggctaggatgtggggtggaggaggtgctcacaggggctcactcctctgctgttgggaatggaaatgggttttctgaacggcagtttggccatttgtatgcaaatgtgaactgcaggcatccctcaagcccgcagttccatatgttggcagcttcttagggactacaagtacacaaagagtaacagaaaaaaacattgaaaatcacataaacaggccaggcgtggtagttcacgcctgtaatcccagtactttgggaggccgaagcgggtggatcacctgaggtcgggaatttgagaccaacctgaccaacatggtgaaacgctgtctctaccaaaaatacaaaaattagccaggtgtggtggcgggcgcctgtaatcccagctactcaggaggctgaggcaggagcattgcttgaacccgggaggtggacgttgcagtgagccgagatggcgccactgcactccagcctgggtgacagagtgagactccatctccatctaaaacagaaaaaaaaaaggaaaaagaaaaaaagaaaa

SEQ ID NO: 9932 - DNA, 4845 bp, Homo sapiens
  ENST00000630854
gtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactc

SEQ ID NO: 9933 - DNA, 431 bp, Homo sapiens
  ENST00000627806
gctatctccacatttgtctggcaggctctgcaaaggggattgaggccagtggttctctgtgtcccagaggtgtccctgggagatgtagtgtcactggactagagattcatccttgctatctctgatgcaagacgattgtatcaattcaggctctggaggtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctc

SEQ ID NO: 9934 - DNA, 568 bp, Homo sapiens
  ENST00000630466
cccacccagaaggggtgcctctttggggctcattcctgtacctaccaacagcctgaccccttgctcctgttcagctgcccctgagggcagggcctggcaagaaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgg

SEQ ID NO: 9935 - DNA, 569 bp, Homo sapiens
  ENST00000631055
tggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatgggtaatggctggcccacgggggcgggcaggtgggggcggccaccaggtgagagaaacagctcatgagagcgacctctgcctctgcctggctgaacaaatgcctctgccgcactcacaataattgagtggtgagcacagcttggaaatctctgtggttgtttggaggtcttgttatcatggaatttgaacagtagcttgtgtgtgctgcagct

SEQ ID NO: 9936 - DNA, 3628 bp, Homo sapiens
  ENST00000627169
aagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 9937 - DNA, 401 bp, Homo sapiens
  ENST00000628466
cgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtgagcagctggctgcacgctgggtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtc

SEQ ID NO: 9938 - DNA, 527 bp, Homo sapiens
  ENST00000627243
caccaggtcgccatccacacgctctggaacatccgcatcgtggtgctggccaagcctgagcacgagaaccggatcagccacatctgtactgacaacgtgaagacaggcattgcaaacacactggttcccaggtgatgtgcagctgctggtccagggaactccctttgggaaccactgacctagaatagatcagaacgttggcagaaaaagggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagagg

SEQ ID NO: 9939 - DNA, 958 bp, Homo sapiens
  ENST00000628814
tgcagcaccatagtgacctcacgtgtggaggaattttgtctgaaggtcagaaaagatatttccttgtgtcattagcctgatggaccgctaactagcactgtttctaaagcagaaagcctcctctggggcctccttacaaatccaagctgatcttgcctagctggggcccaggaatgaagacagccatctagaatcttcactgttctgattctctgctgagcagatgctgctgctcctggtcccctgccctctgtacacccaatgtggcctcaaatgccctttgcatcctggctgtgccatatttgcacactaaggagttctgctgcagcagggctggagggctaagtctcacttccccccacctgctatgctcctcgccccacacctatggcaggagtgacttcctgccacagtggagggggaaccagtgaccccgtgctagatggccgctttttccttgcattaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttccca

SEQ ID NO: 9940 - DNA, 439 bp, Homo sapiens
  ENST00000629540
attaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacaggggtgagtcctcttcatagacaccttccctgccctccatctcctccccgctggtgtctgttcccaaaaggtgaacagaaagtgtcttcatccattaggc

SEQ ID NO: 9941 - DNA, 568 bp, Homo sapiens
  ENST00000627349
gccaccctgccaccatcactctgcagcccgggtcatccagctgcccgcccccagccccgaagcttgtcaggcctggatcagcagggcttctcaccagaggcccgggcatgttcttgttccaggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagac

SEQ ID NO: 9942 - DNA, 588 bp, Homo sapiens
  ENST00000628842
aagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagc

SEQ ID NO: 9943 - DNA, 528 bp, Homo sapiens
  ENST00000629792
caccgagctcccgcatcacggcaagcaccggccggaggaggggccaccagggcctctaggcaggactgccatgcaggtgcgctgcgccacacgtgggttcgtgtgcatttgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagccactg

SEQ ID NO: 9944 - DNA, 5274 bp, Homo sapiens; identical to SEQ ID NO: 9930
  ENST00000359570

SEQ ID NO: 9945 - DNA, 2545 bp, Homo sapiens; identical to SEQ ID NO: 9931
  ENST00000451407

SEQ ID NO: 9946 - DNA, 4845 bp, Homo sapiens; identical to SEQ ID NO: 9932
  ENST00000445964

SEQ ID NO: 9947 - DNA, 431 bp, Homo sapiens; identical to SEQ ID NO: 9933
  ENST00000467393

SEQ ID NO: 9948 - DNA, 568 bp, Homo sapiens; identical to SEQ ID NO: 9934
  ENST00000474278

SEQ ID NO: 9949 - DNA, 569 bp, Homo sapiens; identical to SEQ ID NO: 9935
  ENST00000496402

SEQ ID NO: 9950 - DNA, 3628 bp, Homo sapiens; identical to SEQ ID NO: 9936
  ENST00000415617

SEQ ID NO: 9951 - DNA, 401 bp, Homo sapiens; identical to SEQ ID NO: 9937
  ENST00000493078

SEQ ID NO: 9952 - DNA, 527 bp, Homo sapiens; identical to SEQ ID NO: 9938
  ENST00000472517

SEQ ID NO: 9953 - DNA, 958 bp, Homo sapiens; identical to SEQ ID NO: 9939
  ENST00000493632

SEQ ID NO: 9954 - DNA, 439 bp, Homo sapiens; identical to SEQ ID NO: 9940
  ENST00000480983

SEQ ID NO: 9955 - DNA, 568 bp, Homo sapiens; identical to SEQ ID NO: 9941
  ENST00000465281

SEQ ID NO: 9956 - DNA, 588 bp, Homo sapiens; identical to SEQ ID NO: 9942
  ENST00000417661

SEQ ID NO: 9957 - DNA, 528 bp, Homo sapiens; identical to SEQ ID NO: 9943
  ENST00000491070

SEQ ID NO: 9958 - DNA, 2954 bp, Homo sapiens
  ENST00000379554
ggcctctgtaaggagacttggagtcgctgcagccaaggctggagccatgagacggccccctggcaatggagaggcggccagcgaaggtccaggtggctggggtctatggggagtccaggagtccaggaggctgtgctgtgccggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 9959 - DNA, 2878 bp, Homo sapiens
  ENST00000379556
tctggagctccagctgcgccccgccaccactggccgctcgcactaccagcctgtctcgcacgctaaggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 9960 - DNA, 2237 bp, Homo sapiens
  ENST00000528567
gttgtgccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctatggggatacagctgcaggtaaaaaagacaaacatctctgccctcctgctgtggtttttattttggcacattcaaggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgta

SEQ ID NO: 9961 - DNA, 1702 bp, Homo sapiens
  ENST00000530161
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 9962 - DNA, 1576 bp, Homo sapiens
  ENST00000525218
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 9963 - DNA, 1077 bp, Homo sapiens
  ENST00000447214
cactcacaagctcgggttaccaatacatagtgttagatgcgaagggaatgggaagccaggatggagacccactctcctatttggcaaaacttgctaatgaggctggacaacagccttgccttgaggcttcaatctccactagtccaggcactggtgagaaaaattgatgcctcagacaatatctacaccacagagtccaccacagggaacctgttcagcctgacccaggagggggctcccttgtgccgcatcatagccaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 9964 - DNA, 763 bp, Homo sapiens
  ENST00000526102
agtaggtgagggttagtatccaggaaagaagcttggatggaagaagtcaatccagaattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgat

SEQ ID NO: 9965 - DNA, 2943 bp, Homo sapiens
  ENST00000424273
gttgtgccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggtggagtctcactctgtcaccaggctggagtgcagtggtgcaatctcggctcaatgcaacctccgcctcctgggttcaagtgattcccctgcctcagcctcccaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattccc

SEQ ID NO: 9966 - DNA, 3010 bp, Homo sapiens
  ENST00000340368
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaa

SEQ ID NO: 9967 - DNA, 596 bp, Homo sapiens
  ENST00000425172
atgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatctttt

SEQ ID NO: 9968 - DNA, 1127 bp, Homo sapiens
  ENST00000342407
gggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaa

SEQ ID NO: 9969 - DNA, 1320 bp, Homo sapiens
  ENST00000476756
ctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtctt

SEQ ID NO: 9970 - DNA, 852 bp, Homo sapiens
  ENST00000468307
ggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggaaagcttacttaactttcattaaaacatccactaagcttagatattttcatattttatttgttttttatatagaatgatacagatttaggcatgaaattctcaaaaatgctgctatccataacttaatgtaacgcaaaggaaaaccaagtagtagcagttacaaccaaacaaatatgaacattcgtaacattggatggttgatatgcgttctgcatatccccactacagagaatctgtgatgtagaattgagccaggtgaaattgactgctaaggtacagtttcttttctcgctccaggtatacatccccagatttcctctatattcgttcttggctcccttgtatatttttctcaggaggcgtcacggtggggaacataggacgacagttagctatggtaagtgaaatgatcatattatcttctaaaacttgcgtctctttaccttgatagaatgactttacatgatacattcaaatttgcgttcatatattctggttcagacttgagtgacaactactgagaaaagcttatatttaaaaaaataggtaatgatacccaggtaattctt

SEQ ID NO: 9971 - DNA, 2623 bp, Homo sapiens
  ENST00000344756
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 9972 - DNA, 498 bp, Homo sapiens
  ENST00000470622
tccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcagtgttgctttctcaaagaaataaacatgtggctggaagtgtttaatggctgcgttttgatcgtctacaacaaggttacagtgccctctggtggcagtcatcaaaatcgcttctagacttgtttttatttttaaataaaagatctaattatattggaaa

SEQ ID NO: 9973 - DNA, 6689 bp, Homo sapiens
  ENST00000265198
tttaagtagaatcctcaagcttggcctcagagtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgtttaa

SEQ ID NO: 9974 - DNA, 3267 bp, Homo sapiens
  ENST00000422970
acatgtagtcttctcactttcttcttgccatgagactgagagagtgctccttgggacggagtttcagagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagca

SEQ ID NO: 9975 - DNA, 2245 bp, Homo sapiens
  ENST00000522590
ccttctagcttcgttttctgccatatcttgtaggggtctccacatacttggcccagcctgctccctcagccagagactccccttcacaagttgtgcaccactgatagtttagtgatcctgccagtttcaattcattaggattcctacaatcaaaattaatcaccactgattttgtgttctcttggtattatgactcacacctcttttgaggaattattttattttccccaagctacgatttgtcttcttcctgcatattggatgctctttgaggtcaggagccccgaattggccatttgtttctgcctcttatgtaattcctttgcaccaggtagttaccaggtagttcattagatatgaactttctgaattggattgaaattgcaatagccagatggagataaacctctgctcatgcattatggaataagcgatgacagcgttaaaacattaagcattttcatttttgttatagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactc

SEQ ID NO: 9976 - DNA, 1658 bp, Homo sapiens
  ENST00000367220
gtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagt

SEQ ID NO: 9977 - DNA, 1621 bp, Homo sapiens
  ENST00000519344
agctcaatgtatattgattctaattagcacattttgtgcctcagctagtagctccccgttaagctctgcctggagagtttttttttagattccatcctgctcataaacactgccacctcctccctccttctctctttacaaatgttacaacacaatcagaaatttcctcttttctttccttcctgcattttcagcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaag

SEQ ID NO: 9978 - DNA, 607 bp, Homo sapiens
  ENST00000519091
atgtttatctgaatccgttgtatttcatgcacgtttgctctgtaaatcccagatccccctcctcaccgccccagtgtttatttacatttccagtttatttatcttccaattttatgttctccctttgcagaaacctatctaatggtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaat

SEQ ID NO: 9979 - DNA, 394 bp, Homo sapiens
  ENST00000484827
ctctttggtcaacatttgctttctatttgaattttaggtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtacc

SEQ ID NO: 9980 - DNA, 580 bp, Homo sapiens
  ENST00000517438
aaaagttgcctttcactctgtcacataaatcaggataatactttacctaccaaatcagggtaatacattatctacctcttcatgtaatcattgcaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatc

SEQ ID NO: 9981 - DNA, 558 bp, Homo sapiens
  ENST00000519405
agaaaaactggcagtgagtcgggaagtagctgtgtattgaggtgggcattaacccttcaacatctattgcataactacggctgttattgttgagaggagctatgttactgcactgatatgcccgccagccttacaattttaattattttcaacttattcttggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaac

SEQ ID NO: 9982 - DNA, 568 bp, Homo sapiens
  ENST00000519190
tctccattttgtgtacgttgagtgtggcttttctccggggtgccttccttgggatcagatttctgtctgtcttaatgctaataagaggaggtggacggcagattaatttttggttattgttgaatcgattttaagaaatgacgacatgttgttcatttggattaatccctcgtggtatgtcaaaagagcttagaaaaactggcagtgagtcgggaagtagctgtgtattgaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggat

SEQ ID NO: 9983 - DNA, 585 bp, Homo sapiens
  ENST00000518162
ataaacactgccacctcctccctccttctctctttacaaatgttacaacacaatcagaaatttcctcttttctttccttcctgcattttcagcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcagtaagttgtctctcatcttccacaaaactctgagccaggatactatctcttcataatgttcaccaagggatatggtgatttagaagtgagtgaaggtaacatcggaatgtctgagaatttgaagcattatgggttggcaccctacatagaaatagaagcatttaacctctcattttctggaatttcgttttgtggagcagatggatttt

SEQ ID NO: 9984 - DNA, 485 bp, Homo sapiens
  ENST00000520261
gactgagtttccagagctgaggctgctttaagtagaatcctcaagcttggcctcagagtactatgaggcttctgaatccaggaataagactgctcttggatttactctctttgtattgcatagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagca

SEQ ID NO: 9985 - DNA, 9762 bp, Homo sapiens
  ENST00000357086
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 9986 - DNA, 9717 bp, Homo sapiens
  ENST00000456211
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 9987 - DNA, 9513 bp, Homo sapiens
  ENST00000443694
atgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 9988 - DNA, 264 bp, Homo sapiens
  ENST00000491868
gcggttacagaattgtgacacgtccaaattacagacaaatgctcttctcaaaacttctctgcactttggaaagctctgcatttcaccgagcttaagttgctatctatgtatctatacttcagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagca

SEQ ID NO: 9989 - DNA, 2151 bp, Homo sapiens
  ENST00000477577
aatgcacagcacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagctgccacgattccctgtatgtttacccatctgcccgtttccctgtgtgtacctgtctcacctctgccacccacctccacggtccccagtgtctccttggctccagctgtaagacctgccagtcctgccacctgaagggaagggaaggggaagaaagaaaggaagtgaaccaattaatacttttaaaagaaaaggaaagggaagataaagcaaggcttttattattttttaataaaataaataaaactgcagataaaatgcct

SEQ ID NO: 9990 - DNA, 580 bp, Homo sapiens
  ENST00000494681
agttgctaactggctgttctcagtgcagggaatgccctgaagtatctttaacctgagagctcttaataaatatttgttcattaacggactagttaaaataaattgcttgtgaagtctttttaatttaaaattagcttcaaggaagtaatccgtggttttccccccattcaggttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctg

SEQ ID NO: 9991 - DNA, 697 bp, Homo sapiens
  ENST00000487016
ttgagctggacgaagacaccaccagatttcgtagtgtcactcatctcatgctttcaacaccagccctggcctgccacctgacagccaccttctggccctgagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccaggtaggaaggcagcttggctactggtatggcatccctgctgagcaggaggagagtctgttctgggagccagatgtctgggtggtaccaagccttgtttgagagacagctcattctgagggcacaaaattctgttttgaaaaatgagttctgctagtatcctgctgtgatcatttggtcataaatcagacttggttccagaacatgagttacatttgaaaactgataaaacactgagaatacgcaaaggaaactggcctaagatctggcacat

SEQ ID NO: 9992 - DNA, 591 bp, Homo sapiens
  ENST00000479831
ttttcctctgaaacacactgtacacgtaggtgaaatggtagatccacaagtaaggtggcagggcctggctcggttttaatcctgtctgaggactgagagcagattgtgacttctttgagtgttttgccaactttgaacgtctctaggagataaaggaatgtaggtttctgagtgtcacctttggagtggtgaatagggcccatgaggactctgcagcctttcatgccttatgcttgctttctagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactgga

SEQ ID NO: 9993 - DNA, 552 bp, Homo sapiens
  ENST00000481415
attgctgccttctaaagaaggacattaaccagccacagcatgtctcttggtctaagtagagtgaatgagtttcatttctcacgacaggagaggtggattggtattgatggcctgtgccagtgtcatgaaggattctgaggctgtgtccaagcccgataggagagagtgcggaacagccttttccctgggaggggagacagccagtgtgcatgctgtccatccagtcctgtgtgggtcttccttgaaacaggatttttgttcccttggctcttcttgcaggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtg

SEQ ID NO: 9994 - DNA, 571 bp, Homo sapiens
  ENST00000467545
attgcattcctggcgttccggcttggggtctccagcctcacgcggctttgcctttgtctctgcagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtc

SEQ ID NO: 9995 - DNA, 1793 bp, Homo sapiens
  ENST00000493491
aattgtagcatgatgctcatgacacggaagttgcctttctccttcccttggagaaatctgattcaggcaggggacctgcagttttcctttgcatacttttaatagaaattaagtttaggcttccacgtcgccttctttgagtgaagtgtgacacatgcatgagttttatttctcgaacgagcttttcgtgagtacctgccaggcaccaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttg

SEQ ID NO: 9996 - DNA, 2215 bp, Homo sapiens
  ENST00000463980
gtagcatgatgctcatgacacggaagttgcctttctccttcccttggagaaatctgattcaggcaggggacctgcagttttcctttgcatacttttaatagaaattaagtttaggcttccacgtcgccttctttgagtgaagtgtgacacatgcatgagttttatttctcgaacgagcttttcgtgagtacctgccaggcaccaggtacttcccctggggaatgtgcaatctggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcatttt

SEQ ID NO: 9997 - DNA, 632 bp, Homo sapiens
  ENST00000490572
aagggaagaacttcccagcagaaggagcatgtgtggaggcttggaggtcaaaaaatgctgatgggactggttatggatggggcagagaatttgaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccag

SEQ ID NO: 9998 - DNA, 652 bp, Homo sapiens
  ENST00000472205
aaagaattgtttaatcagccgtgaattggggacttcaaacattttaaccatatgctgccagattgttcatcataaaatttccttctctctcccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatc

SEQ ID NO: 9999 - DNA, 910 bp, Homo sapiens
  ENST00000478515
aaactgaagacgcagaggaagagctgggagtagggctgagtagctgcggaactagctcatcaggctcctttcctctctatcacgtgaggtggtgccgcaaagtcagctgcgtggaaagggttggctttggctctctgttcagtagacttagggactgtttccatcagggttaggcctgatccacctgaacgcacagtgaatatccctcctggctgtgtcacaccacacttggagaagtcgcaattgagacaggggacatgaaaagagatgcagttttcagtttaaaagttgaatgcccaatttaatttctacccaagtagatgaggtctcacttgagctgtgccccaggctccgcagaccaaagggtcgcaagggacccagactgatccagacacctctcttttccaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcaggtaaagaaagaaa

SEQ ID NO: 10000 - DNA, 10197 bp, Homo sapiens
  ENST00000302640
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 10001 - DNA, 10242 bp, Homo sapiens
  ENST00000354582
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 10002 - DNA, 4131 bp, Homo sapiens
  ENST00000544951
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 10003 - DNA, 1483 bp, Homo sapiens
  ENST00000467056
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtaagggtagggtggagaaagggctcctgggtttagaggatatcagcctgtatataggctctctctctctctatcctacaaatattcatacatacatatacctatatgtgtctatacacccacatacacacacctacacacacacacagaatacatgtgtgtgtatatatataagtcacaaacaagtacttatacccaccttattccaaaaatgggttggggatggcatagtgaagtaagtgcatcatggcatatcatggtgctgcatatttgtgcagaa

SEQ ID NO: 10004 - DNA, 9762 bp, Homo sapiens; identical to SEQ ID NO: 9985
  ENST00000357086

SEQ ID NO: 10005 - DNA, 9717 bp, Homo sapiens; identical to SEQ ID NO: 9986
  ENST00000456211

SEQ ID NO: 10006 - DNA, 9513 bp, Homo sapiens; identical to SEQ ID NO: 9987
  ENST00000443694

SEQ ID NO: 10007 - DNA, 264 bp, Homo sapiens; identical to SEQ ID NO: 9988
  ENST00000491868

SEQ ID NO: 10008 - DNA, 2151 bp, Homo sapiens; identical to SEQ ID NO: 9989
  ENST00000477577

SEQ ID NO: 10009 - DNA, 580 bp, Homo sapiens; identical to SEQ ID NO: 9990
  ENST00000494681

SEQ ID NO: 10010 - DNA, 697 bp, Homo sapiens; identical to SEQ ID NO: 9991
  ENST00000487016

SEQ ID NO: 10011 - DNA, 591 bp, Homo sapiens; identical to SEQ ID NO: 9992
  ENST00000479831

SEQ ID NO: 10012 - DNA, 552 bp, Homo sapiens; identical to SEQ ID NO: 9993
  ENST00000481415

SEQ ID NO: 10013 - DNA, 571 bp, Homo sapiens; identical to SEQ ID NO: 9994
  ENST00000467545

SEQ ID NO: 10014 - DNA, 1793 bp, Homo sapiens; identical to SEQ ID NO: 9995
  ENST00000493491

SEQ ID NO: 10015 - DNA, 2215 bp, Homo sapiens; identical to SEQ ID NO: 9996
  ENST00000463980

SEQ ID NO: 10016 - DNA, 632 bp, Homo sapiens; identical to SEQ ID NO: 9997
  ENST00000490572

SEQ ID NO: 10017 - DNA, 652 bp, Homo sapiens; identical to SEQ ID NO: 9998
  ENST00000472205

SEQ ID NO: 10018 - DNA, 910 bp, Homo sapiens; identical to SEQ ID NO: 9999
  ENST00000478515

SEQ ID NO: 10019 - DNA, 10197 bp, Homo sapiens; identical to SEQ ID NO: 10000
  ENST00000302640

SEQ ID NO: 10020 - DNA, 10242 bp, Homo sapiens; identical to SEQ ID NO: 10001
  ENST00000354582

SEQ ID NO: 10021 - DNA, 4131 bp, Homo sapiens; identical to SEQ ID NO: 10002
  ENST00000544951

SEQ ID NO: 10022 - DNA, 1483 bp, Homo sapiens; identical to SEQ ID NO: 10003
  ENST00000467056

SEQ ID NO: 10023 - DNA, 1000 bp, Homo sapiens
  ENST00000512104
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgttaggtcctcaaaggtatgtggaaacaagaagaaatccctggtactgttcatgttccctcactgacatccagttccagttagactttataatacaacacattaagaaatctacagaaaatttgactttgatttattccttttaaataaaaagtgtttcttaaaaggcttgaaacatgtatctgttaacatgaattttaaaagaacaattatgaatgcataacaaaatagccaaaccaaacattgctttgaattgctgcacaaataactgattataactgttatgacctagaaaaaaatcataaaaacatttttctttttggcaagatgtgagttgctgtagaattataccagttctttggttctactttccaaataaatatatatataatgcaatgtaaa

SEQ ID NO: 10024 - DNA, 3675 bp, Homo sapiens
  ENST00000514049
gcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaagatttgtgatcctaatccacctgggacagccccagatatgttcctaagaagaaaccagacttaagaataaaagaacacgtgtcaagagaaacctaagaatgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 10025 - DNA, 4208 bp, Homo sapiens
  ENST00000335894
tccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 10026 - DNA, 819 bp, Homo sapiens
  ENST00000535744
gtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgtggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggccatgaaagtcaaaacacctttgagagccctgaaatcactgtgggattatgacttttta

SEQ ID NO: 10027 - DNA, 1699 bp, Homo sapiens
  ENST00000559568
gtgcttggaaaccgcgcctccgcggaggtagccgttccctgacctagccatggcacagaacactgaaaaccacgaccctgtcggatccatcttaatccagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattaggtataacacttttgcctgcaaatctatcagcaacctctattacccaccacattatggctccttgattgagttcaaggaaggccccttgttttattcaaattggtctcggcaggaaaatgttctcgacatgatgagagtaataacacaggaccctcgcttgaaacggcgtttaatttggggattaagcaaataaagtcattatgtgggggctgctattcagtggagaggtgatttgctgtaattcgctttcatctgtatgaaatgaactaaaaagttgtatttttccccgaaataacagataatgttttcgatcttctttaatgatagaagaacacaggcttgtatgtgttgttgctgttacgccaataagccaggatattgcttgtacactgtttttaatcaaatgtgcagtcaaaatgataagctacattctctgaaattatttagttctaattacgagcagatgggatgctttatttgcacctagggcgcctgagcaaaaggaaatgctgtgtgaacaagaataattaagaagttgaatagtgttttttgcacttaaataatctgcagtttcatgttaattagcactaatgtaattatttaattacatttatgaattggggaacttaaaagctgttgtctgaaacacactggtaaaaaaggtatgccaaaatgacattgggaatttcagaaatttgcattggagtttcttttaagacatgagctactgtcaac

SEQ ID NO: 10028 - DNA, 560 bp, Homo sapiens
  ENST00000560497
tttggtgcgccgcccctagactccctccaactcgcgagaggctcccaaaaatgcccacccagaccttcccccacggcccagcacactcccggtgacttaccctgtaggttacgccccagaagcaggactttctgcctctgggaaaactctaaaaccgttcacccggaacctttacttcagaaaaattaacctcacgctgaggcatcatttttaaatgttatattctgaaaaatttgaacccatgacgtcgggagtggaggagagacaaatcggacactctaggagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgaggg

SEQ ID NO: 10029 - DNA, 543 bp, Homo sapiens
  ENST00000561339
aaattaacaaaattctcacctgaggaaaaaggagagactctagacattcagagtcttgaaacagcaatcaaaaggactgaagtggggttaagaccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggt

SEQ ID NO: 10030 - DNA, 680 bp, Homo sapiens
  ENST00000560790
ttcatctctgcctgtctttccaagagcaaagtcgtttaaaggtatcagactcaatctctcccagatccaggaaatgactggaaaggggaggccttggcagcattggtggagattctctacagaagcaaaatttccccacaaaagacagctttgcaagaccacttctgtttgctggccctgtggcaactatttcaaaatatgtcaaagtacatattttggggtaaaatatttttatttccttcacagaggattctgcataaatgtttgttgaatggataaacaaaaccaccacagtgatctctaagagtgtgctcatctgcatgtaaaatatcagttcaggctcctgtgaactcccaaagcagccctctcctatctctgtccttgcacttgttacattgggtctgtcagccactctctgaggagtgcttactgtgtgcccaggattattagaggcacgctgggctgaataagacagatcagatccctgacatcagagagcttatattctagtggggaaagacagaccatcaataagataccaccagataatgataaaagctctgataaaaataaaacagaatgctgtgataaagggagcttaaacttctcatcttccttactgttaaatcacttcttcagtcatttttttacctgtttgccaagaatctcagaaggtccat

SEQ ID NO: 10031 - DNA, 326 bp, Homo sapiens
  ENST00000559172
ccactttcactatacctcgggaaccacctccatctccagcagaagtgaagttctttcccaagaaacaaagatcaaaggggaaaagcagaaggtcaagaggacatcatgataggaaggtctgtaatttgtgtgactagttgaaatttagggtctgtcacctgatgtcccttccttttgctgcagggcaagagtatgggtgactgcttgacagctggagatggcaacaaaagttcgtgcttcctttgtaaaagaaattagatcatggtttcaggaaaaaaaaaaaaacatggttcatttaaagtgaaaacccttttttgcctcctttt

SEQ ID NO: 10032 - DNA, 583 bp, Homo sapiens
  ENST00000561357
tcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttc

SEQ ID NO: 10033 - DNA, 653 bp, Homo sapiens
  ENST00000558759
actgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacaatctctctaatccattcgaggggcccattgttcagacacttgacagataggaagtcctacatgcccattagagccgcgcctcgactgaagccagagcaacataaggtccaagagactcattagttcactggcacaatcgtgtcctgagagtaaatgaaaccctctgtctccttatggctctcatctgctctggactttaaaagaaaactgtctccgttttgttcggcacagtagtggatcattcacatggtgagagcccctgcttaacagtacaaaactgttaaatctatcggaaagttttgcatgtgaattttgattagcactcccgaagctcaagctgctggcaatagcgaaacgatttcgccatc

SEQ ID NO: 10034 - DNA, 3112 bp, Homo sapiens
  ENST00000546225
atgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 10035 - DNA, 3062 bp, Homo sapiens
  ENST00000358767
atgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 10036 - DNA, 1822 bp, Homo sapiens
  ENST00000629425
gtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattaggtataacacttttgcctgcaaatctatcagcaacctctattacccaccacattatggctccttgattgagttcaaggaaggccccttgttttattcaaattggtctcggcaggaaaatgttctcgacatgatgagagtaataacacaggaccctcgcttgaaacggcgtttaatttggggattaagcaaataaagtcattatgtgggggctgctattcagtggagaggtgatttgctgtaattcgctttcatctgtatgaaatgaactaaaaagttgtatttttccccgaaataacagataatgttttcgatcttctttaatgatagaagaacacaggcttgtatgtgttgttgctgttacgccaataagccaggatattgcttgtacactgtttttaatcaaatgtgcagtcaaaatgataagctacattctctgaaattatttagttctaattacgagcagatgggatgctttatttgcacctagggcgcctgagcaaaaggaaatgctgtgtgaacaagaataattaagaagttgaatagtgttttttgcacttaaataatctgcagtttcatgttaattagcactaatgtaattatttaattacatttatgaattggggaacttaaaagctgttgtctgaaacacactggtaaaaaaggtatgccaaaatgacattgggaatttcagaaatttgcattggagtttcttttaagacatgagctactgtcaac

SEQ ID NO: 10037 - DNA, 7233 bp, Homo sapiens
  ENST00000268182
gacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtt

SEQ ID NO: 10038 - DNA, 5863 bp, Homo sapiens
  ENST00000633485
cggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagttctgtgctttcctacagtgaggcctcgattctagactttctgttcagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctg

SEQ ID NO: 10039 - DNA, 3602 bp, Homo sapiens
  ENST00000560738
acttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaact

SEQ ID NO: 10040 - DNA, 559 bp, Homo sapiens
  ENST00000560418
agctaccgccgtccgcgcctccaaggtttcacggcttcctcagcagagactcgggctcgtccgccatgtccgccgcagacgaggttgacgggctgggcgtggcccggccgcactatggctgtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagagaaagttctgaagttctcttccttgccactgattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactg

SEQ ID NO: 10041 - DNA, 1201 bp, Homo sapiens
  ENST00000559809
acgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaa

SEQ ID NO: 10042 - DNA, 376 bp, Homo sapiens
  ENST00000559682
agaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctca

SEQ ID NO: 10043 - DNA, 350 bp, Homo sapiens
  ENST00000560373
gtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgt

SEQ ID NO: 10044 - DNA, 596 bp, Homo sapiens
  ENST00000558003
tggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggg

SEQ ID NO: 10045 - DNA, 565 bp, Homo sapiens
  ENST00000560733
taacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcaga

SEQ ID NO: 10046 - DNA, 440 bp, Homo sapiens
  ENST00000560020
gtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgcagtgagccaagattgcatgactgcactccggactgggtgacagagtgaaactctatctcca

SEQ ID NO: 10047 - DNA, 544 bp, Homo sapiens
  ENST00000560218
gtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatg

SEQ ID NO: 10048 - DNA, 637 bp, Homo sapiens
  ENST00000558491
gtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagtt

SEQ ID NO: 10049 - DNA, 601 bp, Homo sapiens
  ENST00000561132
cgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaa

SEQ ID NO: 10050 - DNA, 720 bp, Homo sapiens
  ENST00000561461
ttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgct

SEQ ID NO: 10051 - DNA, 583 bp, Homo sapiens
  ENST00000559031
atttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcaca

SEQ ID NO: 10052 - DNA, 550 bp, Homo sapiens
  ENST00000559674
taaatgcctcccccatctcgtttcagtacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctga

SEQ ID NO: 10053 - DNA, 2313 bp, Homo sapiens
  ENST00000558957
ttaatgctgcatattattccattatgcagatagatataacagttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacacttt

SEQ ID NO: 10054 - DNA, 2871 bp, Homo sapiens
  ENST00000561086
ttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttc

SEQ ID NO: 10055 - DNA, 5279 bp, Homo sapiens
  ENST00000273221
gcgggcttggctggcctggggctcggacttggggccggagccgcgggagccggcggacgctggaccaggagccccgacgtgatcgcgtggcgggtggtcgggtctccgggtggccgggtgtcggccccgggatccggcggctcgctggcgggagtcggcggcctctgctgggcctgggtcccggctcccggcccggcccgctcccactgcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattactgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactct

SEQ ID NO: 10056 - DNA, 3744 bp, Homo sapiens
  ENST00000618604
cctgagaagccagccaggctgcggctgtttgtggcaggaggcccccacccacagcactggaccaagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctgccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaa

SEQ ID NO: 10057 - DNA, 3582 bp, Homo sapiens
  ENST00000613206
attcccctccacttcttgcctgagccgcctgctcctcttggaaacacgttgagcctccccgctggagagggagccagaacagggaagaacggattcacacaggatggcttgcagaagacgctatttcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctgccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaac

SEQ ID NO: 10058 - DNA, 545 bp, Homo sapiens
  ENST00000473088
aatcgcagcccgccacctgacgccctcgctccagaccggcggggttccggctgcgggagagaggccgccgctcccggcccggcgttcagggcttccggggcagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccgg

SEQ ID NO: 10059 - DNA, 436 bp, Homo sapiens
  ENST00000474467
gcggccgccatgtggtgcctgcactgcaactcggagaggacccagtcccttctggagctagagcttgacagcggatgaggaaagaatggctagaaaatgaaaatgacgaattcaagctctgcagaatatagacctggtcctctggtaaatgcatggaccctctttcccctccctggcattgctggggagcagcttgttagaatgcagcctgaggcagaggcagggaggagcagggggccaaggaggagccggagagacaaaacctgcaggccccagctgtgcgcactccagtggcagcattgggttccctgtacagccaccgtggatggctacagaggtgcactaccatcagcagagtggaaggagaatccttggaagctctacccagtgcctacaatctcaaaaacatgttcgccagccccaggaagtcatctgg

SEQ ID NO: 10060 - DNA, 7094 bp, Homo sapiens
  ENST00000538872
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccacgggatcgcgaggtcatgtatctgcaaaatgcacctttttaaagagtgtcttagttccccagccccagctaatacccggccaatgccgtgtacgcaccggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccagggacactctcccagacagccctgacccgccaggcaggaccccgtcccctgctcacacagctcttcaaacttaccaaggacaggcaggaccccgtcccctgctcacacagctcttcaagcttaccaaggacaggcagaaccccgtcccctgctcacacagctcttcaagcttaccaaggacaggcaggaccccgtcccctgctcacacagctcttcaaacttaccaagtgccctctcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgagcaaa

SEQ ID NO: 10061 - DNA, 2701 bp, Homo sapiens
  ENST00000382841
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaa

SEQ ID NO: 10062 - DNA, 398 bp, Homo sapiens
  ENST00000540907
ggtttctcttgctcacgggcctctgcattccttaggggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaatgccactgttccagcgcctaattaagccacgagctctttctcccctttccccagcctgctgccctccgaggccgagctcccagactaacacagtggagacggagctcacggcaccctagggccatccttcctgtgt

SEQ ID NO: 10063 - DNA, 539 bp, Homo sapiens
  ENST00000537151
agccctgcggagcccagggggacccacagtcaaagcaaggatcgccgacagccaaaagggaagccgcgctcagggagaggccggcggagagcacggtggaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaagctgcaccccctctgcagatctgaagacacacctcactctcccagggccctacacagccagacccggcgaggcctcctcttcccctggccaccactttcccccattggaccatggactgaagaaaacgagctgagggtctaacg

SEQ ID NO: 10064 - DNA, 526 bp, Homo sapiens
  ENST00000544511
ctgggagaggcagtgagcatgagtcaaaggtgacatggacttgaatctccccaccccgccccgcctgcagtagccgggccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttg

SEQ ID NO: 10065 - DNA, 3232 bp, Homo sapiens
  ENST00000575724
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggag

SEQ ID NO: 10066 - DNA, 2701 bp, Homo sapiens; identical to SEQ ID NO: 10061
  ENST00000571363

SEQ ID NO: 10067 - DNA, 398 bp, Homo sapiens; identical to SEQ ID NO: 10062
  ENST00000574111

SEQ ID NO: 10068 - DNA, 101 bp, Homo sapiens
  ENST00000573139
agccctgcggagcccagggggacccacagtcaaagcaaggatcgccgacagccaaaagggaagccgcgctcagggagaggccggcggagagcacggtggag

SEQ ID NO: 10069 - DNA, 3483 bp, Homo sapiens
  ENST00000256458
ttccccgccggtccgcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 10070 - DNA, 1858 bp, Homo sapiens
  ENST00000302006
ctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccagagagagacctcgtccccaggccagattcgccggcacagcagttaaagtcgcccttccagccggtacgcgacaactctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 10071 - DNA, 2630 bp, Homo sapiens
  ENST00000382611
ctcccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaggtgtcacaattgctttgaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataatatgatgtttggggcttatttttcctagaagaatgatttggggtagagcgctagtgaataacctccaggtgatctgacctcacctttttaatgaaaacctgtgtgaaataaactctcctttctctcctgagcattgaaaaaaaaaaaaaaaggcagatggaagagaagtatataatcgggagaaacatgtgctgtagatgatttctatacaggtattgcaaaaaaaccaaaaaacataagatttttgtgccctgagtgtgctaattacttgttagtgtaaatttttaaaacttggcaaaataaaatgatctgacacccta

SEQ ID NO: 10072 - DNA, 2456 bp, Homo sapiens
  ENST00000302057
aaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgtccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttg

SEQ ID NO: 10073 - DNA, 2401 bp, Homo sapiens
  ENST00000394636
cttagcatcttggcaggacctttgcaaaggcaaaagcagagccccccggtgcaaagagcgaggggaaaaaagagaaagcagcaagggaggggaggggaggggaaaaaaagcccagctggggcgagcgaggcgcgcagaggagcgggcgcggcggtcgcagccggaggcgcgcgggaagccagcgaggaggcgccgcgggccggagccccggagccggggccagaggagcggcggcccagggcagccagaggccaggtgcccgcccgctcgccctcgcagggcgccgcccggctcgttggcggccgcggcgcggcgcgccccatgcccgtgtgtggccatgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 10074 - DNA, 879 bp, Homo sapiens
  ENST00000560154
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgctgttgaaaaaagaaaaaaagagccttgacttcccttgttttccccccttgcgcccaacgtgcgtccgctcccccgccgagcgcggagtcgcctcagttgcccaggcctctatctgcatggagggccgggccgccgtggccagatctgcgcacgggggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacag

SEQ ID NO: 10075 - DNA, 2061 bp, Homo sapiens
  ENST00000320990
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 10076 - DNA, 1825 bp, Homo sapiens
  ENST00000558597
aagagccttgacttcccttgttttccccccttgcgcccaacgtgcgtccgctcccccgccgagcgcggagtcgcctcagttgcccaggcctctatctgcatggagggccgggccgccgtggccagatctgcgcacggggtacggacgtgcccgggcagatgggggcctacggggtgacaccgaggccgggacagcttcaggggccccagaaggacctgacccagaaattgaggtccccgctgccttctgaggagggggaggagttgctcctaggtctgaaccccgccagccttgccccgtaggaagctggagtgcgggcctcgtccacccacagaccccggggagcgcagggaaaagggtgcttcggtcgttccgatggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccg

SEQ ID NO: 10077 - DNA, 881 bp, Homo sapiens
  ENST00000620085
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgctgttgaaaaaagaaaaaaagagccttgacttcccttgttttccccccttgcgcccaacgtgcgtccgctcccccgccgagcgcggagtcgcctcagttgcccaggcctctatctgcatggagggccgggccgccgtggccagatctgcgcacgggggctctccctacgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacag

SEQ ID NO: 10078 - DNA, 2039 bp, Homo sapiens
  ENST00000582811
ctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 10079 - DNA, 2420 bp, Homo sapiens
  ENST00000338128
acttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 10080 - DNA, 1703 bp, Homo sapiens
  ENST00000457269
agcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttcca

SEQ ID NO: 10081 - DNA, 696 bp, Homo sapiens
  ENST00000582287
gggcgcggggttgcccggcgaggggtggcagggacccgggcaaactcctgctgcactccaggtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctc

SEQ ID NO: 10082 - DNA, 793 bp, Homo sapiens
  ENST00000581672
acaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcaggtgcaccccagcctccagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 10083 - DNA, 1691 bp, Homo sapiens
  ENST00000578963
gggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 10084 - DNA, 1654 bp, Homo sapiens
  ENST00000582770
ttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatgctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 10085 - DNA, 2148 bp, Homo sapiens
  ENST00000577916
gcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggtgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactc

SEQ ID NO: 10086 - DNA, 1466 bp, Homo sapiens
  ENST00000577820
ctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgacc

SEQ ID NO: 10087 - DNA, 860 bp, Homo sapiens
  ENST00000583816
ccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgctatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggacccc

SEQ ID NO: 10088 - DNA, 371 bp, Homo sapiens
  ENST00000583309
cggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggtgcggcgcggcttcaggggctgctatgggaggcagggcttggccaccgcccccatctcctgacccacccgccccgcaggactcgctgctggccgcacccatcatgctggacctagcgctgctgaccgagctgtgccagcgcgtgag

SEQ ID NO: 10089 - DNA, 592 bp, Homo sapiens
  ENST00000578352
gcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccg

SEQ ID NO: 10090 - DNA, 627 bp, Homo sapiens
  ENST00000581800
ttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtggaccagggggctgaggaaggaggcgtgctggggagagcggggcggctcggggagaagggcacgggacccgggattcactgcgcggcctgtcttcaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggc

SEQ ID NO: 10091 - DNA, 629 bp, Homo sapiens
  ENST00000583534
ttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccga

SEQ ID NO: 10092 - DNA, 10192 bp, Homo sapiens
  ENST00000423218
gtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggtggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaccaagcactgacatcccattctgtgggcagagcatatcacagtgagccatactcccctttgaaggagaggaagtagaatgagggagttccttgcttcctcccccctacctctacatgtcagaagggactcatccaccatttgctgcccacaacatgccctcctagtggctgcctggcctccgtgtgacgtctccagtggtggagcgctccctctcccaagatcacccttccatctatggccagtgtggacggttaggacctaaatgtttcactgtagcttctgcccttggttccagctcttccctctcacgcctcccagacttctccaggccggtttcattgttaaccgtcttacactctgacatcagccaaggcgtctccattctgttcttgtgccattcatgtcttggattcccagtaagtagaaccttggaaataatttgatcttgtttttgcataaatgaggacactcagaaccaggaagagccctaggctcccacagcaaaaccaaaactaaacccaggactgctatttcccaagccagattctgttattcgagcccagccttagaagggcttgatgtggagcaaaaggtgaaaatggtgaaactaaaatttgagtatcaaaacccattgccttctaatagaatcagaaggaaatgttgctaaatcatattccatttccgtcatcactcttatgaatggggtaacctggctaaatgagaattaatgaacccacactcataagttttcattgacttagcaccaagtcgtccatcaaatatcatcagatctgagaatgctcttatggatatctgatttttagaggctggcattcatatttttaaaaactgccacctgtgaccacactgcaggccaaacagaatgtacctgctggtcagatgcagcccagaggtcactgaattgcaacctctggactctcggtcagaggcaagcagcccttattccagaactccacagtccttcacacccttccccagacctacaccaagaccaactaagtggtcaaaaggtggacaaactgagagttgtatcaaggcccttagcctctcaatttgttatcaagtttccctttctgaatctatttaccctgaagtataaatacccaagatgagccttaagagtgcctggtagagcaaacaaagatgcatcttatagggagcaaagtctatgctaacgcagtgtttctcaatcctggctgcacctttgaaccacgggagctttaaaagtgaccactgcaagggccctacccactatggatcccaatttcattggttgggagaggggccaagtttgtttccaacttccccagatgactctaatggctgagagttgcaatcaacaggtaagtgaatatccaggctgtaagatgaagaaagagggggttgtgcccaagcccactgtgcctcataaagcagatgatctctgcagcgctgcgcttctcaaagagtggtcccaggactgcctcagtcagaccacagactcctaagttcctcctcagacttcatggatccaagctctgtgaggtaattctaagcacattaaacttgtagaacagccatctggatttaatattacataatagctataatattctgctattctctaatcttcaatgtcagtttcttaaactgtcaggcctgtctttagatgcccttcaactgtgctggggactatcttgatggcagccagcaaagaaaatcagcaaaaaccccagtggagtttctgggttttacttttgttaaggaaggtgatggtttcttgacatgacaggtatctaggtggaaagggcaaagtgctaatgcaaacacaatggagacactatggaatagctctgcctagggacatgtggaagagcttctaggagacagtgtggacctttccatccctagaggtcttcacaagataaattcctacctccgtcagtattcaaaaggttttagcatcaatactgtctgagaataagacattagacttgagtcagtcccctggcttcaatcccaggatgccaagcagcctctaatggagaccgctggcttaatcgtgctcctttcctggcataacaactcactgcacccatgcctcaccaccacgaagcagtctcctcaccacccaaatgtgccttgggtgacttaaatacagccattagtatgaatggtcccctgtttttattcaacaccacaccagtctttgcttttaccttcggctaatgtggttccagccttttatcctgcactccttcttataatttaaaaaaaaaaaaaactcccctactatctttatgttaatattaacatcaactaggttcttctcaaaggacagccaggcctaactggccacgttaaaatctgcacagtgcttttgtgtcactgtctattctattagtttcaacatcatgctaaaataggacagcatgttccaaaactgaaactgaaacaggaacggagccttgctgatttagcatgaggagggaattgtaagccttgcacctggacactaaaacttttcaataagatgtatgctaagccgtacctagcaaacttaccaggtccaaagtagagtacaagcagaaagttatttttaaaggatgggcactatccttgagggacttaccctttctaatcagctttgcatggtttgttttgagacagtgtctcactctgttgcccaggctagagtgcagcggcaccatcacagctcacggcagcctctgcctcccgggctcaagcaatcccacctcagtttcccaagtagctgggactacaggcacacaccacactcagctaattttagtattttttgtagagacagggtctcgccatgttgcccaggctggtctcaaactcctggattatctccctggccctgcattaaaaaagatgtgcaacaacttagtgatgtgtctgaaatgttttcagaaggtggcccaagtcagagtcaaaaaatttttttatttggaaaattagaggaaatacagaaaatcaaatttcaaatagatgcatctaaatggagaacaagcttatcaaggacagagtccatctttcttatttttatttttgagacagggtcttgctctgtcacccaggctagagtgcagcggcacaatcacagctccctgcagcctcgacctcctggacttcagtgatcctcccacctcagcctcttgagtagctgggactacagacatgcaccaccatgcccagctaattttttttttaattttgtgcagagagggggtctcactttgttgcccacactggtctctcttatttttgtatgcatatctgtggtgcagtgcctgaaatacagtaggtgttcaataagcgccaacatgcaagagtatcttgccattgattaaggcaaaagcaaaaccccagtccgcccctctgatggactgagcacaccaaatttctaaagcacaggcaaattagaaaatataattttgtctaaacttgccaacaagctaaggttttgtgaaccacctaaaatttgcctctctcatactgaaattttctaggtcaagtatctgaaggaatacactactgccagtattttctttggtgatctgtcatatacagcagacattacttgaaacaaagaaaaaaatgttttaaaacctgtctggatgatttccgcagtctcactaggttattgcagccagggagtgacctagcagagatctgaaggtgagcttccctagtactggcatctcacagtgaaagagcactgttcagtgggtcaagagacccagagcctactctcagttacgacacacatagtccttgtgtggcctttctgggcttgtgtcctgaactataaaatgagagggtggcactaaatgtttttttcagatctctatagaggctggaatggccacagagaatctaaatttgaaaacaaacatgtcctgagggtgtgctccaataccaccctttaatactctcctgagatgtgaaggctggaaatgagaatgccatattattgttacttgcaaacgattagtgtatctgggacatccaaaagaagtaactgaaaatttatttctttaaaaacaaaaaaaaccattacagtgcttttgtaaaaacattaatatttagaagtacgtagtggtaataaaaggaaaatagttgtaagaccttcattaaaaagaaaaacctaaaaaaaaaaacaaaacaaaactctggatacaggtgtatgatttacctaaccagacatagctttcttttggataaaaaaaaaaaaaaaaaaaaagctcagaagtgcagaactgtacagatgtccctaaatctattaattcaatgctaaacgaaataatctcttaacatgataaaattacaccaaacttcatctggaaaaataaacacgtaataatgaaaaaagttagccactcccacctccccacttaaaaaagacaaatgaagaaatactagtccaaggccaggtgtggtggctcacatctgtaatcccaacactttgagaggctgaggtgggaggactgcttgaacccaggagttcaagaccagcctaggcatcatggcaaaaccccatctctacaaaaaataccaaaataaaaagaattagctgggcatggtggcacatacctgtagtcccagctacttgggaggctgaggtgagaggatcacttgagcccggaagatcaaggcgacagtaagccatgatggcaccactgcactccagcctgggtgacagaatgaaaccctgtctcaaaaaacaaacaaacaaaaaccaaacaaattataggaaaatcaacattttaaaccaaagaagagaaggagaaagaagggaagggaagccataaaagtgtctttttcaaatagatcatgggggaaaaaaaaaaaaagtatgacttggaatagagacagccttacaagcaggatctaaaactcagaatccatttttttaaattgtgataaatttgactatagaaaaatgtaaactttggatacaaaagtaccatatttaaagtaaataagctacaactattacatgacagagaaaatgtcctcaaacttctaaggaacttctaacaagtagaaaaaaaacacacacaaccccaaagcaaacaccaatagtcaataaatatatgaaagtgttcaatgttactcataataaaggcatacaaatcaaacc

SEQ ID NO: 10093 - DNA, 3955 bp, Homo sapiens
  ENST00000315757
gtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtg

SEQ ID NO: 10094 - DNA, 783 bp, Homo sapiens
  ENST00000569346
ctttattttctccagcaggggctggggtgcagtgagttctccctaccctccaaacccccttcctgggtcctgcctcttccaggcctccccagctgcccctaggaattatggccctgcgtgattgaatctgctcagctagccctgaacctaccccatcactggcccatcctctggcactgccaagccatgcaccgggccaagcaacgcctgctgaggacacggtgccaaagatcagcctgtttcctcctgtggcagggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctcc

SEQ ID NO: 10095 - DNA, 567 bp, Homo sapiens
  ENST00000566429
attttccttcctcttccaagtgctggctgtttgtctgcctgtacccagtaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctgggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacg

SEQ ID NO: 10096 - DNA, 670 bp, Homo sapiens
  ENST00000562826
actcacttcctttccttcggtggcctccaggatgatctggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgt

SEQ ID NO: 10097 - DNA, 401 bp, Homo sapiens
  ENST00000565868
agagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacggtaaaaaaaaagtagaacaaaaaaaatttttttagatctcagatgctattgtagttatctattgccttgtaa

SEQ ID NO: 10098 - DNA, 651 bp, Homo sapiens
  ENST00000568677
gaacagggccttgaaaaaacaatgaaagagactccaagatcagtttttctccattagacctgaaaccaaaggaactagtacacattgcagcaagagagagttcagttagacccaaagaagatccctcaccccctcacccctcagatagaagtctgtcttgggtcgtggaggatgggagtgggcctcaggccattggacctcgatcctctctgaggtcccctcactgactggggatctgcactgccctccccaggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacggtaaaa

SEQ ID NO: 10099 - DNA, 7869 bp, Homo sapiens
  ENST00000296585
ttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagtta

SEQ ID NO: 10100 - DNA, 3782 bp, Homo sapiens
  ENST00000503810
accgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagcgtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggg

SEQ ID NO: 10101 - DNA, 3501 bp, Homo sapiens
  ENST00000513685
gcaactacggtcccccggtcagacccaggatggggccagaacggacaggggccgcgccgctgccgctgctgctggtgttagcgctcagtcaaggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccaggg

SEQ ID NO: 10102 - DNA, 3487 bp, Homo sapiens
  ENST00000509814
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcagttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctg

SEQ ID NO: 10103 - DNA, 3674 bp, Homo sapiens
  ENST00000509960
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 10104 - DNA, 3530 bp, Homo sapiens
  ENST00000510722
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 10105 - DNA, 1846 bp, Homo sapiens
  ENST00000476089
ggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtggaccccaccatagggcaagtcctggaaagattcacgttgcctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctcagatttgtgacaagttgaaaaatgtgtactgatagaggggagaagtttcatgtttcaaagccaaagacaagtttgttgcacacaggcaagtggggaaagaggaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgaatggtttaatatgttgtctgctgagctgatgggtcatctgtaaacggtgaataaaattggtacttctttatattt

SEQ ID NO: 10106 - DNA, 1403 bp, Homo sapiens
  ENST00000339307
gctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaaggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctg

SEQ ID NO: 10107 - DNA, 4189 bp, Homo sapiens
  ENST00000397033
gccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctattgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctgga

SEQ ID NO: 10108 - DNA, 1721 bp, Homo sapiens
  ENST00000465522
gaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaaggtaattaaaattatcaaattggtacttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctg

SEQ ID NO: 10109 - DNA, 2070 bp, Homo sapiens
  ENST00000233573
ccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaa

SEQ ID NO: 10110 - DNA, 592 bp, Homo sapiens
  ENST00000484404
tgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaaggt

SEQ ID NO: 10111 - DNA, 1144 bp, Homo sapiens
  ENST00000478440
agtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgattatgtgaaaaaatttggagaaaattttgcatcatgtcaagctggaatatccagtttttacacaaaggtaattgttcaaaaaatagctgctataaatgtttacatatagaatcttaattcttctcatggtttggaagactgatatgttttaaagtaaaaattgtgtaacatcttcatcatgtctcttaaacttgagtattacaacttaatttttgccactcaaaattccacatatatttcaataaaatatcaatatttaggtggctatactgcataagatgaatgaaaatctatactaaagaacatttctttcatcaacaatttaatgaaaatcaaaagtagctatggttaattgtcttgttaacttaggtattgaaaatatcaacccaagtatgttattttaaatttctagttgaggggcaaaggaagaatatcagtctatatttttcattaaattatgataattgggaaatttaagaatttaatatccccttaaatcagatagacaatattcccaagatttcttactctctttctaacattctaggatatgtatgaaagggcacagttgtactcaaccccaaatctctcagttttcttaaaaacacactgtgaattcaggaatgttttttgactccatgaagatcaggcactatatcaagtttggggttgacagtgtctgcacatattaacagttatattaaaatgcttacaaagaaaatgctttcttcagtttaagttgactttttttaagtttaggattgtttaggagtatagaaatatgctaaagatatttaattgctgaaagtgttcatactataccaggcaagggcatgctcattccaatcttctcctaaattttcctctgtataacaaaatatgccccacattccattggacttttttccctaagctaacattattagaaatgttttccctaagctaacattattagtcag

SEQ ID NO: 10112 - DNA, 573 bp, Homo sapiens
  ENST00000473002
gcagagctcggatcagaccccagtggtctggctgtagagcccgcgctctaatcattttgttacactgcctctcagatgcttccactctgctttcttccatgtgcaaactattgtgtgcaatcctgtatatgatgatgatagtattttatttttttctgtctgagaagactgttatttttcataaaagagagttttcttatgtgatatgaattaaggttcataaggttagttttcgaagttgcattctttgtatcaagaatttatttttccattgtttaaattattggatagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcag

SEQ ID NO: 10113 - DNA, 720 bp, Homo sapiens
  ENST00000490435
tgagaaaaaaaggaatatgaaacatgcaagacttttattagcaacaatttttatatttttgaaatttttatataaagattaagcaaataactaaagattttaatgttgttaatagaaacctagaggaaagttcataaatctttataaaagcaatttttaaaatttgtatttttaattgttccctctttcatatttcaggttagtctttaaaaagctgtttaataaagagaattccagatattatttccagtagtccatataactttaactattatcacttcaaaaataacaatagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttt

SEQ ID NO: 10114 - DNA, 1004 bp, Homo sapiens
  ENST00000476824
atagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgtaagaaaagttaattgtgttaatatttgtaacaacctaaaaggatgtcactgatgcattgct

SEQ ID NO: 10115 - DNA, 393 bp, Homo sapiens
  ENST00000468948
tacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctggtataatttattgttaataaaatgaactagaaatatacccccatattctgaggggggggaattaggagaaccgtaaaactgtgttccattaattgtaagagaaaacttctcttac

SEQ ID NO: 10116 - DNA, 4996 bp, Homo sapiens
  ENST00000552564
gaagcagacatagggtggaactacctggcatagaggtgggaatatgagggcaaagctgaagagggagctagggacagtggtctgcgtctctaaggaatgcctgcccctgggtgtcctgtacacatctgttctttaaccatgggatattctgggagtccaggaccaatgggcctatctcttcatctcccaggtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctggtgagttgtgcctgaggccccttttcaccttaaaattccctggtcactgacccctactctctcttctgcacctttccttaagttcctgggtgcagttctggctaattccaacagagggcgctgtcttctcacttcaacctccctgagcgttgaaaccaggaggggttaggaagaaaggatcctgatctggggcttgctgtaagaggtgatttcttgacttcttacagatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcagggtatggcccagagggcggggtgtggactggccagggagggtggccacacagaactgagggcacctcctgaagggaaaaagactgggggactccagtgaagggcttgggactcttgtaggggctgagaaagggagaccttctgtcagaggagctgggaagcaggctgccagggcctctgaaacaatgaggatggtcggaattgggccctaagcagacaaagggagatgagagaggctgaggagcagggccactaagtctccagagtcccctgactccgtgaactctctcctctggccccagaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggaggtgagatcctgaacactggcatggggaagaggagcagattcagaggaccaaggctgaggggttggggaaggttgctgggggcctgcaagaggcaatgaggatgtgcctatagctagggttgagggtcacaaggcccaaagttacctcaaaatcctctggaggaaaaaggactttcatccactgtgtttctttctgcctgaactatcccttctttgtttcccggcatacccctagggcccagttatgtgccacctcctctaggaagccttcttcaaaccttttcctctgggcccgaatgcctgttttatagttcatttactcattaacatctaattaaataagtgactgtactgaacactgttaggcccaggaaatattgcaccaaacagaactgacaaggtctccacgttcatggaacttacattctagtgaagggtgatagacatagaaaagaaaaagagaaggagaaaaattaacagggattgaaaggtgatgaagtgaagagttaataagctgtagggacactatttaaattggatcatagaaaaacctcttgaagacgtcacagctgaactgaggcctgaaagataaggttgaacctgtctataagactcagggatgagcattccaaaccaagggaacatccagtgcaaaaacaggaacacagacctaattatttacttaagcatctcctccagtgtgatctccaagaaccaagttttcctcatttccatattttaaccctgagctcagtgccttgcgcataggaggtggacagttggatgaatcaataaagagatagatgaaagaataggttgaagctgctctggaacccaggtgcaagctgacttagaagctgtaatgagatgggaaaggggcccaacactttcttttatagttggatcccgagggttccctgcaccaccagcaaaaacgggaagctccaagccgcagctctgcttcctcgggacctcagatcctggtaagtcaggcagggaatgaggtgtggaccaaagtgttgagtactctggggttctcagggccatcacaagggcagaacaccaggttcaagcttctttcttcctagaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaa

SEQ ID NO: 10117 - DNA, 4444 bp, Homo sapiens
  ENST00000293379
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaa

SEQ ID NO: 10118 - DNA, 757 bp, Homo sapiens
  ENST00000547197
aacgggaagctccaagccgcagctctgcttcctcgggacctcagatcctgcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtc

SEQ ID NO: 10119 - DNA, 505 bp, Homo sapiens
  ENST00000549601
gagagagactcaggaagaatgagcccaaaatagggaaagatcacaaccccagccagacgatggggaaccctatgtcctctggatcccaagagaggatgtgctaaccaactttcccctacccacagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggagggg

SEQ ID NO: 10120 - DNA, 588 bp, Homo sapiens
  ENST00000552431
aacgggaagctccaagccgcagctctgcttcctcgggacctcagatcctggtaagtcaggcagggaatgaggtgtggaccaaagtgttgagtactctggggttctcagggccatcacaagggcagaacaccaggttcaagcttctttcttcctagaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaaggtcagccacatcctgcttgtgacttggccaccctctcatcaggctctgcccttgacctggcacagtcccaagtatctacctctagaccagttca

SEQ ID NO: 10121 - DNA, 1333 bp, Homo sapiens
  ENST00000552387
aaagggcctggaggtgagatcctgaacactggcatggggaagaggagcagattcagaggaccaaggctgaggggttggggaaggttgctgggggcctgcaagaggcaatgaggatgtgcctatagctagggttgagggtcacaaggcccaaagttacctcaaaatcctctggaggaaaaaggactttcatccactgtgtttctttctgcctgaactatcccttctttgtttcccggcatacccctagggcccagttatgtgccacctcctctaggaagccttcttcaaaccttttcctctgggcccgaatgcctgttttatagttcatttactcattaacatctaattaaataagtgactgtactgaacactgttaggcccaggaaatattgcaccaaacagaactgacaaggtctccacgttcatggaacttacattctagtgaagggtgatagacatagaaaagaaaaagagaaggagaaaaattaacagggattgaaaggtgatgaagtgaagagttaataagctgtagggacactatttaaattggatcatagaaaaacctcttgaagacgtcacagctgaactgaggcctgaaagataaggttgaacctgtctataagactcagggatgagcattccaaaccaagggaacatccagtgcaaaaacaggaacacagacctaattatttacttaagcatctcctccagtgtgatctccaagaaccaagttttcctcatttccatattttaaccctgagctcagtgccttgcgcataggaggtggacagttggatgaatcaataaagagatagatgaaagaataggttgaagctgctctggaacccaggtgcaagctgacttagaagctgtaatgagatgggaaaggggcccaacactttcttttatagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaa

SEQ ID NO: 10122 - DNA, 568 bp, Homo sapiens
  ENST00000552583
cagaatgtgggtgagggtggcgcctatgaggctgagcttcgggtcaccgcccctccagaggctgagtactcaggactcgtcagacacccaggggtgagatgagactctcgagtgggatttgggaggatacccctctagaggggacaccaaaacctgaccagtgcccaccccatctccagaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcaggtagggagtgagtgtgtctaggctggggctgagctggggacggaagggagggctgggcgccattctcactggctgcactccagcacctcagtcttgcctccatcccacagcaagaatctcaacaactcgcaaagcgacgtggtttcctttcggctctccgtggaggctcaggcccaggtcaccctgaacgggtcagtgccaggcaaaatggggtct

SEQ ID NO: 10123 - DNA, 354 bp, Homo sapiens
  ENST00000551564
gggagaagggacctgggaagacagaggcctgggtattgggggggcagggccatggaaagagaagagcctacagcccaggaatgggtctaaacttcccctctcaaggctgccctgctccccaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcc

SEQ ID NO: 10124 - DNA, 582 bp, Homo sapiens
  ENST00000550141
atgcagaggacacacattctggcgcttgggcatcagtttcctgtgtccaggttacagaggagtcctaattctattgaccccacattcactcttggcaggggccgccccatcgtgtccgctagtgcctccctcaccatcttccccgccatgttcaacccagaggagcggagctgcagcttagaggggaaccctgtggcctggtgagctggtgcccaggaaattgcagagacctgagcctgggagtgggcaggggcaccaagtctgccttaaaaaggggaaaatggtggtgtcctagtctgggtctggctgggagataggtagaggataggatgtctgttccagttggattcaccagctttcttcttggtctctctccagcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatcta

SEQ ID NO: 10125 - DNA, 536 bp, Homo sapiens
  ENST00000551861
ttccttaagttcctgggtgcagttctggctaattccaacagagggcgctgtcttctcacttcaacctccctgagcgttgaaaccaggaggggttaggaagaaaggatcctgatctggggcttgctgtaagaggtgatttcttgacttcttacagatctgattgtggggtcctttggtgtggacaaggctgtggtatacaggtatgagctccaaagggagatgaggggacaacctgggtggactggaactggaaatttctcaacagagctgaggttgggaaaatcaatgcagaggacacacattctggcgcttgggcatcagtttcctgtgtccaggttacagaggagtcctaattctattgaccccacattcactcttggcaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactc

SEQ ID NO: 10126 - DNA, 1240 bp, Homo sapiens
  ENST00000435631
aggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacgggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccag

SEQ ID NO: 10127 - DNA, 1013 bp, Homo sapiens
  ENST00000553071
gctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctg

SEQ ID NO: 10128 - DNA, 547 bp, Homo sapiens
  ENST00000547744
ctaacttcaggagctctccctcttcagcctacccatctcctattcctctggaccctgccttctctcccctccattctcaccactggccctcacagacccctcctcactctcctcttccgtcccctcggacctgtcctctctgctgcttccatcccctatacctcctgggccactcctccccgcctcagtatacctggtcttcttggaaaatacccccagctcttgtgacctctaccataatccttcactttgggccttcttgcctagtgagaaagctgaggaagctcctctctccactcctgctgcctgatttccaagactcacattttcctcctacacgccccaaggctgggtggctgggcagccggatgcctgggtcttggcccagggaggggatttggcttgggaggagagtatataggctagatgagagaccctgaggctccacaggaccttggcgctccagaagctatacatctaatctcagcagggtcagtgtgctggtgggagcacccaaggctaataccagccagccaggagtgctgca

SEQ ID NO: 10129 - DNA, 3935 bp, Homo sapiens
  ENST00000553804
ctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 10130 - DNA, 4120 bp, Homo sapiens
  ENST00000257879
gccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 10131 - DNA, 1965 bp, Homo sapiens
  ENST00000554327
tgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatgagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 10132 - DNA, 4084 bp, Homo sapiens
  ENST00000347027
tgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 10133 - DNA, 3763 bp, Homo sapiens
  ENST00000452168
gacacagagtgagtagacaaggcttcacatactgggagatctggctgggcttcaagagagggggttggtggtggtgtggctaagttccaaatgttggcctgaagccagtgctcaaagaaagggggcccttgagacagtccaaatggctccctttgccactcccatggttcaagctttgactacaaccagaattcagaggcaggcagaaggattccagtgctggagagaatgtggaacaaggagatctccatttgagggcaaggaaacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 10134 - DNA, 3930 bp, Homo sapiens
  ENST00000555728
tcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttgggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagg

SEQ ID NO: 10135 - DNA, 817 bp, Homo sapiens
  ENST00000557555
gctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgg

SEQ ID NO: 10136 - DNA, 1040 bp, Homo sapiens
  ENST00000557058
agcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatgtgaggggggcagagagcagggtgggggtgggagggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagt

SEQ ID NO: 10137 - DNA, 296 bp, Homo sapiens
  ENST00000557488
gtatgtagagtgcctgggattttgtagcctctcaataaaatagaaaacatacctgagtgactggggggagttgaggcctggatcttgtctgcaaggcccccagccagcgtgactgccttttccctgtgccctgcagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgg

SEQ ID NO: 10138 - DNA, 558 bp, Homo sapiens
  ENST00000556273
accgctgtgtcacgtgaggttgggaaccgccctcttgagaccttgggtgaagatcttggcggggaagagaggtagagggttgcggagggcaggtgaagtgttctttattgggagcttagtttttgccactcccatggttcaagctttgactacaaccagaattcagaggcaggcagaaggattccagtgctggagaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggata

SEQ ID NO: 10139 - DNA, 707 bp, Homo sapiens
  ENST00000554543
agagaaggagcaggacccccgcctcatcccggtccctgccaacagctactttggtagggacctctccccggcccagaactgctctaaccctctgctcctctctcttgtcctctctctccatgctcccatccttctgtctctgtttctgtctctcaccttgtctctctctgtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagct

SEQ ID NO: 10140 - DNA, 576 bp, Homo sapiens
  ENST00000557257
agctttgactacaaccagaattcagaggcaggcagaaggattccagtgctggagagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgt

SEQ ID NO: 10141 - DNA, 972 bp, Homo sapiens
  ENST00000553276
aaagaccggagcggtcaagctgtttccccactgaattccctcaatcacatttatgttcttttcctcccagccactcccatggttcaagctttgactacaaccagaattcagaggcaggcagaaggattccagtgctggagagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagtgcacgctgggcctgcagctggggcctgcatgctccaacacactagcccacacctcatcactgccattcccgtctccgcacgctgctgctggctgagctgacactcgggttgctttttgtgaccaacattgatagctcagaccccgaccagctggtgtataaaactttggaccctgctgaccggctcccaggaccagccggagacttggccctcaatagctacttagggggactttccctgaggggatggatggtgggcacatattgaagaaagggctaatgttgttggcttctctattgactcggggaaaggtctggtgcgtgcagaagagctgagctttgtggctg

SEQ ID NO: 10142 - DNA, 573 bp, Homo sapiens
  ENST00000555687
gagacagtccaaatggctccctttgccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttg

SEQ ID NO: 10143 - DNA, 552 bp, Homo sapiens
  ENST00000554724
agaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagt

SEQ ID NO: 10144 - DNA, 570 bp, Homo sapiens
  ENST00000553737
gtgtcacgtgaggttgggaaccgccctcttgagaccttgggtgaagatcttggcggggaagagaggtagagggttgcggagggcaggtgaagtgttctttattgggagcttagtttttgccactcccatggttcaagctttgactacaaccagaattcagaggcaggcagaaggattccagtgctggagagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcact

SEQ ID NO: 10145 - DNA, 493 bp, Homo sapiens
  ENST00000556371
agtgctcaaagaaagggggcccttgagacagtccaaatggctccctttgccactcccatggttcaagctttgactacaaccagaattcagaggcaggcagaaggattccagtgctggagagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggcccca

SEQ ID NO: 10146 - DNA, 558 bp, Homo sapiens
  ENST00000553893
gtgaggttgggaaccgccctcttgagaccttgggtgaagatcttggcggggaagagaggtagagggttgcggagggcaggtgaagtgttctttattgggagcttagtttttgccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaat

SEQ ID NO: 10147 - DNA, 561 bp, Homo sapiens
  ENST00000555809
ggtaagtgacctcccagtccttctcaagtgttaagggtttcttttggatcgtcaaagaccggagcggtcaagctgtttccccactgaattccctcaatcacatttatgttcttttcctcccagccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggcca

SEQ ID NO: 10148 - DNA, 588 bp, Homo sapiens
  ENST00000554359
attcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggaggtgtggccctgcatgaacagagtgggggaagcgtgtgagcggggaggagaggacttgggctcctcttccctcccctaattcccagtgtcctgcctctagctgatatgcaaaaggaaagcaaggagaaccagtggttgggagtcagtgttcggagccaggggcctgggggcaagattgttgtgagtattgcttctcatgactgaatgcacggatggggtgtgtg

SEQ ID NO: 10149 - DNA, 6755 bp, Homo sapiens
  ENST00000378076
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggacccagttggcacctgctatgtagcaattcagaacttcagcgcctatgccgagttctctccttgccggaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagtaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagggttaaaaatcaaagctttctgatacctgacagtgacccaggaaatggaggggaccctggaaacatcacctcatctacaccgcactttggagaaattgtcctgggtgcccagtgagccctgttggaaaaggaaacaccaaagctggagaagccatcagcaattgtggaagattttcttttgctttaatcgttctgtacttggcagacactttgaaatgcgtatgggaacgtaagttgcagtccagatcaatccagcataagttgcagagatgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctacctttggagtgtttaaaagtcatggtaaaatgtctagagttcattaattaaaaagcaatttaacattatgggtaaacattatttttaatatctataagaagcaacacttcttatagatatttagcttgggattaaatacccgtttttcctgctatgccttgtacttgtatacacagagaaaacatgttgaatataacttagacaaaaacataaaattatacaggcatgagccaaactgggaaaactgattcctaaagatttttatttaaaattgcttattccaactttattacttatttttactgctaatctttataatatgtaactttggagaataatcttttatttaagctattttcccatcatcttgaatttaaccatcacaaattttttatgtttaaaactcttgtaaataattcataatcttgtaatattatcatttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagaacaagctgacccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgtcctggtagcagtttcgggtcggtcaggagctcaaggctggtttgtgtggctgactacggatgagcactgaagttgcctcaaagaattaaggggtgtccacaccagcctctgggggtctttggtgttagtcttccaggtagagctggttttacaagtaggtggccatctacaggatgtgatgtgagcgatgccagacagctctctctgaccccaggtaatgccctgaatctggtgatcctggctgatctgtgaccaatagagattagctccttgggatttggggtcctaaaaggtccctgaaaaaatgcaccccttgtctttaagccaacattggtgaaggaactgagaactcttagggttacataaaaaaagacccctgttgagatagtttatgcagatacctggaaggaactagagatgccaggaggaagactgagacccagaatgaagcaaggcatgagggctccaaagtgaactgcaccatcccagagtctcagccaagatggccctttcctagagggacgggcaccttccacctgcccacaggcactgctacctatgggaattgcagaaggccgttgtacacacgcgcatgcacgcagtggccctctgccctttagaatatggaagcaaagtctgggtgcagtgactcacacttgtaatcccaacactttgggaggccgagacgggcagatcacctgagttcaggagttcaagaccagcctggccaacgtggcaaaaccccatctctactaaaaatacaaaaattagctgggcgtggtggcagtctcctgtaatcccagctacctaggaggctgaggcagagagagaatcgcttgaacccaggaggcggaggttgcagtgagctgagatcgcgcgactgcactccagcctgggcgacagagggaaactctgtctcaacaaaaaaataaataaaataaaaaataaaaaaagaatatggaagcaaatggagaaagggaggaaactgaggtcaggcaaaccttccagcaatccgttctgcccagagaacatactgacgacagagaacacactgagcgttatctgcttctagttagagcattgccgattgccttcataattcataatgtgctgtgctcctctgagggtctatctgtatttctcttcaaagaattccctttttaaattcttgcagctgggttttaagacacaataatggggcaaattaagttttataaacttggagatttttatacagtaaataaaaaaataatatgtactagtcacccctgaaactgcattcttagaactcgactcttgttttatttaaatacgtgcgtagatatctgtgaagattttcatgtacctatttaccttgtcactaataaaattaaaactgaaagacttga

SEQ ID NO: 10150 - DNA, 850 bp, Homo sapiens
  ENST00000477064
gctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaatgtaagagagaaccagaaatactgactgatttccttctaactggacttcacagggaacaaatggaaagctctccagttaccactcagcaactcagcacctagcagcaacaacaaattaggcaggaaattgccagagtagtgggatttcacattataacctacacagagtgaatcgtctcaagctaaaaacacagaaagatgcatgctcttctatgctttctctttatacattactcttgcctgtcttttagttacaacaattttatacagactttgtttttactatagatattttctttaaatactttttctttgaattcaaaaagaaatgcaatgtaagttaaagactctaaaaataaccaaattaggacaaagattttagcaatggcaattaaaggaaggacatgacattcaacagtgaccatagaattcccttttcaagggagattcaggtacgtatttgcattttaaagatgctgataagtctttcagttaataaaccttttagcctgatgtttcatacttttgcttgagcatttgaaacttttctcaagttagaatattatgctagaatgatatttttgctcttttatgctataatgttgcgttgatcttgggtattcaaaaatgtgctgaaactacagtaagctcacttcttggggcaaaaataaataaatatttcaatggcaagtaca

SEQ ID NO: 10151 - DNA, 349 bp, Homo sapiens
  ENST00000468882
cttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctggtgagttagtccggtgcttctcaaactccaatgtgaattcacatcacctggcctgggtgacagagggagactctgtctc

SEQ ID NO: 10152 - DNA, 2282 bp, Homo sapiens
  ENST00000422441
ccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggtta

SEQ ID NO: 10153 - DNA, 7889 bp, Homo sapiens
  ENST00000264741
ccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggacgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagagcaactaacttgcctcctgccggggtgtaggtgcgttggtgacagtgtagaagggtgattcgcaggcccatgttctgcccaccagcaaagccccactggagaagggtagactcctgtgggcagtctcagagctgggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcagtattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaa

SEQ ID NO: 10154 - DNA, 428 bp, Homo sapiens
  ENST00000461533
aaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatgg

SEQ ID NO: 10155 - DNA, 609 bp, Homo sapiens
  ENST00000411817
gaaaaaggacagttcgtctgtcatccagttcatgtcccgcgccaaggtgaaggtggatcctgccctaagggtggtggaaatagctcatgggaacccagaagaggtgacgatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaa

SEQ ID NO: 10156 - DNA, 7030 bp, Homo sapiens
  ENST00000261023
cctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtacca

SEQ ID NO: 10157 - DNA, 6903 bp, Homo sapiens
  ENST00000374907
ggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacgtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggt

SEQ ID NO: 10158 - DNA, 3288 bp, Homo sapiens
  ENST00000433736
ctttgtagctcctggagattcaattctttcttgccagggtctttctacctctgcctcacatattccctccatctcttcattccacttccctcatccccaccccccactcccctccatcctcaatacacaaatgctcctaggcaccctccttctgatcctgtacatcttaatgttgtgccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgt

SEQ ID NO: 10159 - DNA, 604 bp, Homo sapiens
  ENST00000460641
gccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgaggtttgcagttgttagattttactcaaacctcgtgagcaagccaacgaagagaggaacaactaagctactttaaaaaaaaaattctatgtaatttttatgtaaactctacattggttaagtatgtgtcagagatttctttgaatattttccctatacataaattcatttttatttgacaaatagacttgtttaaataaagcagtttatataatttgttgtttaaaataaattagttctacttgaa

SEQ ID NO: 10160 - DNA, 437 bp, Homo sapiens
  ENST00000496477
ggttttctttggtcattgtttagagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctg

SEQ ID NO: 10161 - DNA, 611 bp, Homo sapiens
  ENST00000496854
ccactgtgcccaaccttgtttatatttttatcctgacacatattactctgtgttagagacaaatgttgagtttgatcatttttgcataaaaatggtcacattgtaattagaggttaactgtggaaattgctgttatttaaaacctattgctaacatgatttctaaagttgatgtaggggaaggattatggaacagatttttgcccaaggtgtagatacattttcttttttctccttagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttg

SEQ ID NO: 10162 - DNA, 333 bp, Homo sapiens
  ENST00000474571
gtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttgaacaactacatttatttttataccatgcattcctctcactttc

SEQ ID NO: 10163 - DNA, 736 bp, Homo sapiens
  ENST00000430709
tgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttagaaagttggaaattaactgcaacaagtgaggcattttgaagatatttaaggagtaaaaatgggatcagcacat

SEQ ID NO: 10164 - DNA, 5554 bp, Homo sapiens
  ENST00000579662
ccggcggcggcacccagctcctgccccgacaggtgcgcgccgcgcgaaggaatgcagccggtctgactcaccagcgcctccttcctacctgcgcgcccgccccataaagcgctgcccgcctcgtccccacccccccaacccccgcgcccgccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgact

SEQ ID NO: 10165 - DNA, 5919 bp, Homo sapiens
  ENST00000200181
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 10166 - DNA, 5645 bp, Homo sapiens
  ENST00000450894
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 10167 - DNA, 2798 bp, Homo sapiens
  ENST00000580542
gcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagtgagtagaagactcgtgggtgagagggcccccacttcctgcccgcctgtccccagcccagccactgcctcgtccgtccctactccatctccatcccata

SEQ ID NO: 10168 - DNA, 5689 bp, Homo sapiens
  ENST00000449880
ggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 10169 - DNA, 2895 bp, Homo sapiens
  ENST00000584558
atggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctga

SEQ ID NO: 10170 - DNA, 458 bp, Homo sapiens
  ENST00000582629
tccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 10171 - DNA, 950 bp, Homo sapiens
  ENST00000584374
ccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaagggcctgcctggcacttctcccgtgctgcaaccgaggtcacatggtgggctttaaggaagac

SEQ ID NO: 10172 - DNA, 804 bp, Homo sapiens
  ENST00000584025
tggaacagagggccttccacgacctcaaggtggcccccggctactacaccctcactgcagaccagggtaggagggcgggtccgctgtgccactgcctcgcacctcccgcctgtgtggccctgtgacccacctctgaccacctccgaacccccacccagacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccggacggagtctcactctgttgcccaggctggcgcgatctcagcttactgcaacctccacctccagggttcaagcgattctcctgcctcagcctcccaagtaacagggactacaggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccag

SEQ ID NO: 10173 - DNA, 699 bp, Homo sapiens
  ENST00000583327
gaacagttatttctccagtcctggaagggaggcagggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggc

SEQ ID NO: 10174 - DNA, 411 bp, Homo sapiens
  ENST00000579211
ggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagag

SEQ ID NO: 10175 - DNA, 603 bp, Homo sapiens
  ENST00000584939
gcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgg

SEQ ID NO: 10176 - DNA, 688 bp, Homo sapiens
  ENST00000578318
aggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtgggtgagcactgagggctaggggatcccggctctcctgggacagggagctagcagagggagaagggcagaccccaagccaggtcatctaatgcctcctcctccacagatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 10177 - DNA, 4372 bp, Homo sapiens
  ENST00000296181
gcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaatcatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaa

SEQ ID NO: 10178 - DNA, 2228 bp, Homo sapiens
  ENST00000460797
cttatagccccatcccccagccaccagaggagcctgggacctctccccttgaacatcagctttacagcccggcagccagagcttagctccccaccctgtgacctcaggaatcctgttctcccagatgtctccgaagacagacaaagaatgtgtgcaacttggttttgatgatataaagtataataatgaccatttaattgaacgttgtagttaagcattttcacccactatctgagccaccacctgctgttagcctgaggtgggaggagagaggctcaaggtgtcactttttggctgctcatccattttctagaggaggcccctgttaaagaacaagggttccctgggaggagccatcaccctagagcctgtgccagagcctagtgtagactgattcgtgggtaagtgggcagcaggccacgggggacctggcagatgggctctatctgagagggagaagggggctggagcccgagattctccgggacagtggatctcagccctcgacatgcatcagaattgcccaggaagcccagtccccggaggtgtggttgggcccaggtactgggagtttctcttgaaagctccctggagagttgaacgtgcaggagggttgagatccccgccctgggtgatgaccagggcgtgatgtggggaactaggacaatgttggggcattgagctctgaccatgggagtgtgaggagctctgggaggccaggaatactgttttatcacccagaaacctctggcttggagcagactcctcaccaggcattagatggaccagagtgcagatggatttgtctcctggtgtcagaatttgaaaggtctgcaacctgacatgtagacaagacatgccactaaactcacacaggctcctccaagaacccttgggcttcctcccataacaagaagaaaggcagagcagaaacattccctgaggctgaacatctgcagctggaaagaagtgaaagccttcccaggtcctgcactgtcaggagctcagggacaggtgtgggactgttctacattatctgacacccacctttatctcctcttttccaaagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgata

SEQ ID NO: 10179 - DNA, 577 bp, Homo sapiens
  ENST00000461306
aaggcagaactgagatgagacgatgagaggaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtc

SEQ ID NO: 10180 - DNA, 1202 bp, Homo sapiens
  ENST00000481591
gaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatgcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggag

SEQ ID NO: 10181 - DNA, 971 bp, Homo sapiens
  ENST00000488466
atccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccgggg

SEQ ID NO: 10182 - DNA, 475 bp, Homo sapiens
  ENST00000474838
ccactatcaacttctccaaactcacagagggagacctcaggctgggtctagcaagatgttgtagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccg

SEQ ID NO: 10183 - DNA, 789 bp, Homo sapiens
  ENST00000496703
ttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccag

SEQ ID NO: 10184 - DNA, 492 bp, Homo sapiens
  ENST00000476988
agggatggaaatatgcctgaatgtcaacatgattcgggaaaccaatcacagagaccctctaaccttgttttcccttatgtgctgtggagactcctctgtccccaagctcagatctactgtgggagctgcccactggctgcccaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaat

SEQ ID NO: 10185 - DNA, 1164 bp, Homo sapiens
  ENST00000465464
gggcgtctacgtcccatctcaggccgccggcagtgaggctttgggaggatgaggcggtaccggcacgacccccgtacctgctctccctctcgcagtctagcaaccgcctttggcccaagtaatctcggctcgcctaatacagcgtgccccgcccctttcccgtggcgacgggcggctaagcaacgggagcgggctctactcagtggtttcgagccccccacgccccaagtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccgagcagtggccgagggtaccagatggaggtttgaccagggatgctcagtgccttggaaatggattaacacagtgctgcatgtggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtac

SEQ ID NO: 10186 - DNA, 825 bp, Homo sapiens
  ENST00000608657
aactttcattttattatttctttttatcgagacagagtctcaccctgtcgcccaggctggagtgcagtggcgagatctcgactcactacaacctctgcctcctgggatcaagcgattctcctgcctcagcctcccgaatagctgggattacaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgagg

SEQ ID NO: 10187 - DNA, 576 bp, Homo sapiens
  ENST00000483168
gtgccccgcccctttcccgtggcgacgggcggctaagcaacgggagcgggctctactcagtggtttcgagccccccacgccccaagtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatc

SEQ ID NO: 10188 - DNA, 548 bp, Homo sapiens
  ENST00000608107
aaagggagtgagtctgacattacacataccagcacacagcctgtggttttggatcctggagtacctgtctggtacctggtacccggcacactgtgagttcctggacatcaagggctggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggag

SEQ ID NO: 10189 - DNA, 267 bp, Homo sapiens
  ENST00000608945
atctcgactcactacaacctctgcctcctgggatcaagcgattctcctgcctcagcctcccgaatagctgggattacaggtgatatgagaaaacatccaggaaaagaggaacgcattgtgattgctttgctccagcggaaagagggcatttagagaaagaatccaggagagtttcctccatgtctaagctctactgataatcttaaagaaaattttacataagcaatatccgatgtgaaaaaaataaaataaaacaagcatggccaa

SEQ ID NO: 10190 - DNA, 3420 bp, Homo sapiens
  ENST00000537992
ctgcccgggctgcagccgcgcctgcgggcagccgaggcgaggcgctccggtagcgtggggaggtttcctagcaactctctgccctgagtgcacccggctacccgcaggtctggagccccccggggggccagagcaggaccacccctctcccgcccatcgccggcctcgcctctctcgcatcctagccgtgtgcaccccagagcgcgccagcaactcgggctctggactgcgggacgcctgagccgcgcactgaggcgaaaaggacaagggcacgcagcccccgccccgcgaagccgggctccggcacctcgcggaacctcccctcctgcgctcgcagccgcaggccccactccccgccagggagggagcggcgatgcctcgctctgtgcctgcgggtgtcggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtcttgggctggcacgaagagctgcccggccagagcatcccggccagaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttccc

SEQ ID NO: 10191 - DNA, 2054 bp, Homo sapiens
  ENST00000478974
ggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgcaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagtcaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagtatgtgggtgtgcatttttcccttttaaaataaactaagttgtttggcgtactttcttacagaaaaa

SEQ ID NO: 10192 - DNA, 8751 bp, Homo sapiens
  ENST00000222573
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgcaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagtcaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcactttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaatgtttatgcatctaggcaaattttgttttcttataaagatttgagagcccatttatgacaaaatatgaaggcgaaatttaaggacaactgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacatattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaa

SEQ ID NO: 10193 - DNA, 1090 bp, Homo sapiens
  ENST00000460204
gtcttgggctggcacgaagagctgcccggccagagcatcccggccaggtgagtgtcagaagacaaattgaagtattcagctaaataagcaactgcaaaactgaatttattcctcttcaagaactactcttcttgtatgttgagtgaccatttggctgccaagagaaactgctttgcctaggaaataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctatccttcaaaaccagcctcaagtctacctttatgttgagagagtgtatctttaactcatggtgttctctttctcctttcacatttcctgtaaactcatcatgaattgccttgtttattgttttgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcattagtggcttcacaatggttcttcttgtaaattccctcatgacctagagttttgatttatgccatcctagcccactttaagctctgactcatgctgggattgccctaaacagggcagggcagactaatggaatgcattgcattgtcctaacatttcttaacctgcccaaggttgaacatgcttgtttgtttttcttttgctctccaaaaatctttatgctagcgtaaaggcctgttgtaatcacataaattactcactatgtaacaggagaagttgaaatttgtccctgaaacataaagattatatataataaaagccttaaaaaccta

SEQ ID NO: 10194 - DNA, 5573 bp, Homo sapiens
  ENST00000477859
gtcattcatgaactagaaagtggttcatcagaacccgtgaagccaggcatgtcatagagaggacaacttcagagtttctgggtccgatcccatcactgcctgtgagccaaatgaccaaaagaattcactttattctagcatctccctttcctcgtctctataacctcaaatttggtgtctgcttccaggtttttctctgtcaagaatgtttcatggcttgttatttcctgaccccaaaccagtacttcattttagatttttactgcttcactaaggaaaatccttagagccctgaagtttgtgccaacttgctgtcaactgctgaatgctttagtgagggtagtttggaagagccttcaaaagatagtacagaagcccagttgtcagccacatgtaacatgttagccatagaacatcaggcttcagagggaccccttctccctgtcacacctttgactggaagaaaataatctggagagtcacagctctgggaatagctgtcagtcctgccatagaaggagggattttgagtattcggaggaatcagttgtctgatagaaagagctaagtcaaggagaaaggaggtggctgctggaggggagaaggaaaacctgtcactgttggcaacattcttcagatgggatcttagggaaaacggtcagaaactcacttgggtgctcatgttcccaaatattctatatagcgcagtgcagcctagtttatgtattgaaagagcaggctctgaagaaacactgagttggattcaaatcctagttccaccagtttctaatgttataaacttgcacatattacctaatcactttgaacctcagatttccatacctctaaaatggaaatacaaattgaacccgcctcacagtcttgtgaggatgaaatgaagcaatgtgggaagcactgggcacagaggcatggcttaagaaatgggatttaggactatatatagaactttgacaaggttctggaacaactcattcacggttaggaaactaggaggattgcctgcattaataacataacctcaggggaagcagccagttttaggactcagccactatccatgccattaacaggagctgtccactccctgcaggctgacctgacgtcattgagaggaagaatgtattatttaattttggaagatccctcaccctttaggtgcggatgtgactgatgccaatgattcctcaaccagcaaggctggaaggagaggcaagggagaggcaggctttttttttttttttctccccatgattaggttagataaatggtaacaacgtaaacctggcttgaataattttcaaggctaatcaaaagtaaaacgtctctagaaaatttagacaggatgtatccagtttgcttgcactattatgtagcatgttaatctgccattccatatactttgctttctctttccttctacactacataagtaattggaaaataattaggatagaaacagcatcatcaatattacctagtttaatgccccatgttcctttctaacatctatggaagacatgatatgtcttgaagaattcccttcctctcctacctgttgtgtctgatgcagagtgtcatgcgtagtgagagttcagagcgtaggctcggagcatagttatactttcacagcatatatgataggaaaagtttcactgtcaaagggaatatgatagaattctctcacttctgtgcaaattgctatgtttggaagtcaaaaagacccaggcgtgggtaggaaaaaaaaagttttcatatatatatatccccagaatactatattaaattgatgaaaataacaaccaataaaaagccaaccaggtcaggcgcagtggctcacacctgtaattctagcactttgggaggccgaggcaggcagatcacctaaggtcaggagtttgagaccagcctggccaacatggtaaaaccccatctctacaaaagatacaatagttagctgggcgtggtggtgtgtgcctgtagtcccagctactcgggaggctgaggcaagagaatttttagaacctgggagatggaggtggcagtgagccgagatcgtgccactgcactccagcctggatcaggagggagactctgtctccgacacagaaaaaaaaagccaaccagagaaacttcagtctgagcttttccttctcaaataggttttagatgcagaaagttggagtaggatttttgcttgtgtttttcttgtagaaatagtaaaaacataaggattagaagaaattaaaatgatataaaataccaaaaatgcaatatttgctatgtcattttctttggatgtaattgatatacactaaaaacatcagtgattttctttcttttaaacaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaaaaaaacaaaaaaacaaacaaaaaaccctacctaatgttagtaactttgaatgaagcttcaatagttaggctgccatgtatataaatacctctttggaaattctgtatttttattttttgattgctccaaaattgctgaattatgatttgacacattttaaagagtttgtgccaacacgtcatctatctctccattactgtactgtgactggggataatgatgttgtctccgatgtgactacaaagaaatctcagttatcacaaagaaagtgggtcaaaagatgagaatttgattgcttagaaagagccttttttcttatcattttagatttctgattctaaataacatatgtcccactatgaaagaagaattagccttaaaaatacaagtgtctcacacaatattgccattagcctgtggaattttcagaaaaataaatctgtatggatcttttttcacaaaagactttatctttcttgcttctacaaattgcttagattactttacaatacacattccaatttaccgaaacagctctgtcatctgttgtaccggaacaggattgatgcatccatcaatggagtttcataagccttcttgaggtgaatgtacaggaggaatcattcttactttctgggtatcatagattctcaaaataattttaatgaatattgattgttcatcaataattccaccaagcatcactttaaaaattagtgcagtattaaaaaaaactaatatcatatttcaactaaattcctcaaaagcattttccagaagtgtttctcagctgttcaatgataagaaatcactgcacattcttatattcaccttaaaaattcacagcgcagattaaatattgaaagcctttaactgtcctatattaaaaaacatgtttaatcatctttatttttttgaataccaaatgcttatagtcttatttcctatttgcaaagaaattgtcatcagcattgagcttatctctaattttataagcatagattttcgtcgtataaagtttccctggcacaaaagaagtactcccttttcacacaactgtacaattttactgttaagtattccagaatgcttaagaagagcaaaataaactttacacttcttcttttcccacacagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaagtaagacgtttcacatgatcgagtgtttgctaagatgccaaactttcaaagaatttagacgttttattttctctttgatttgtggagtgaaaacgtagtgtagaagaaaacatatcttactatctcttactcctcaccaaggtgattcatttcggtatgtgtttgggacagaggggctaaattcagggagggatttaaataggaaaagacaaaagggaaagaataggttatgaacgcgaaaattctttccaaaagggctgcttttctcatgcgccacactccaaggaggaactagaagtagactgttgccctcctcacttcagcttgttctcctactttttttttttttgagacggagtctcgctctgtcgcccaggctggagtgcagtggcgccatctcggctcactgcaagctccgcctcccgggttcacgccattctcctgcctcagcctcccgagcagctgggactacaggcgcccgccaccacacccggctagttttttgtatttttagtagagacggggtttcaccgtgttagccaggatggtctcgatttcctgacctcgtgatccgcccgcctcggcctcccaaggtgctgggattacaggcatgagccaccgtgcctggcctctcctactttttaatctatattgttcttcctccagtggaacactagaaatctctagccaggaactagtgtggtcacatggctgtgggaaaatagaggatgtacaaataaaagttaaagctatttacgcagcagcgttgtacccacgcacatcgttctagcctgacttactgttcgtcaactcaaacgtaatgtttacttgaggtaaaaaccacagtacacatctgtgttattgtacaaagtctaattacatgtttatttttaagagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggtaatgcagcagtaaccgcttagtagatatgactcttttggttaaagtacaattttaaattggcaactcaactatttttgtaccaggaaattacctacaaaagaaagatacagaacaaggataagccatgagagagaatttatggaacagtgcaatctataaatactgatcaataaaatatatgaataaaacagtt

SEQ ID NO: 10195 - DNA, 568 bp, Homo sapiens
  ENST00000467268
atataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtaagaactttcaccagggggtgggaccgagtggggcagggcaggatggagctggttccccaactgctgaaggtgtaggctataacagctgactcctcacagctggcaaacagcttacggccctctgccctggcagcctccaacagcgcaggactcctgggaaagagcaccacagagtgacgacccctccaacctcgcaggatgtagcccaagagggcccctcacaggcatcccttccttccgcagacacttccttagcacttgctggtacctggctctgtgaagcggtccctgccacaccctcacgaagcatctttatatccctagggggagggggctggaacacctccctagagcctctcaaaattcaacacccctattggaaagagggtgtttggagacttcccttggcacagga

SEQ ID NO: 10196 - DNA, 2220 bp, Homo sapiens
  ENST00000416872
attcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagacc

SEQ ID NO: 10197 - DNA, 3007 bp, Homo sapiens
  ENST00000449956
tcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 10198 - DNA, 824 bp, Homo sapiens
  ENST00000465243
ttccttttaatgggaagctaccccttccctaagtagcttctcagtgctgagctccaaggtagcctgggctaatgggtgtgtgaggccaagaaaaagggagctggaagctgaatcagccaaggcctgtgcccagccaggagccctgatctccaaggggaaaagcggtgctcagaaaggccggagcgtgggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattata

SEQ ID NO: 10199 - DNA, 529 bp, Homo sapiens
  ENST00000463893
agtgctgagctccaaggtagcctgggctaatgggtgtgtgaggccaagaaaaagggagctggaagctgaatcagccaaggcctgtgcccagccaggagccctgatctccaaggggaaaagcggtgctcagaaaggccggagcgtggtaaacagtgccttccaggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacc

SEQ ID NO: 10200 - DNA, 543 bp, Homo sapiens
  ENST00000464804
attcattgtttgctgagtaccaccatgggctggcagatagggtccttgggcacatgagtggggccggctgtcccggcctcctccgctccagcctgtctgcacactggcaccctgaggacaccctcccacggtgctgtctgtctgtgtcccagtgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcaccca

SEQ ID NO: 10201 - DNA, 456 bp, Homo sapiens
  ENST00000465314
gtcagggacaggcagagtgaacattaggagccattaggacgggcccagccctggggcatggatgcccagctgcagcatcagtgggagcctgacctggggcttgagatgactggccccgtgcgaacttcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcg

SEQ ID NO: 10202 - DNA, 558 bp, Homo sapiens
  ENST00000475931
gatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggtggggatagggatggaggccggaacccggaggcctcctgtgctgggcaccctacctgggtgtccagtggaggagtgggccaggctggggagacccagacctgctgaagtagggcatctgaaggaaaactggccacgggatggggaaagtggggtggagcgtgaagcagtcagcatggacagtggggtgtggggtgaataggagcctctgcacctctaaagggaagtgagtaaagggggcacact

SEQ ID NO: 10203 - DNA, 920 bp, Homo sapiens
  ENST00000495622
ggggaaggtggggatagggatggaggccggaacccggaggcctcctgtgctgggcaccctacctgggtgtccagtggaggagtgggccaggctggggagacccagacctgctgaagtagggcatctgaaggaaaactggccacgggatggggaaagtggggtggagcgtgaagcagtcagcatggacagtggggtgtggggtgaataggagcctctgcacctctaaagggaagtgagtaaagggggcacactgcccatggggcatttcaaggaaaaggactgaggctgcagcatggaagggcttagttagacaagaagaagcacttccaacatgaaaggcctggagcaggctatcaggcacctggagattgttaggggaagagtccctgagagctggaggctgggaccccctcaaccagaccccagattgccctactcaacagggggtcccaaatgcccactgcaactaggtacagggtctgtgtgtggtggtggaggattggcattgggagacatgggaggcaaagagctgggcctggccaggccaggcctctggcttccaagaactcctagttccaggggacacccagtgggggaagagctggctgctgggaggcccacagcctagggctggtcggccaagcagccagctctggtccctgctcacaagtgccctatggcttctaatgcatttctcttcttcctcccttgctgcacctgcagatgcagaagccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagaga

SEQ ID NO: 10204 - DNA, 2179 bp, Homo sapiens
  ENST00000493136
aagcaagataggacccccagccatgggggcacacttgggacacctgggctcaggcccagccctattgccaaatcatgaacgtgcccctctctgagcctgaggatccctgtgagttaattgggggtggcttcccttgcccagggagacacaatcagtatgacagtatctatgacctgcaaaaatgagcaatttagcatgtcagtcatttatacttcattagtcccatagcaaccctccaagagggcccttttatgatccccattttacaatggggaaattgaggcacggggggttaatttgctcagtctgtttgctcacagactcagcagatggccaagctggtacttaggccaaggcagtctggccccaatgcccatgctgggaattgctggggatcacagtcctctgtgcctctctcaccacaaaactggaacctcacaaactccctgccactaggcagggcctccccagcccctactggcctgccccacctccatttggactggcacatttggactgggccatcacattcccctcagaacagccctgataaatgtaccggtgcatgtgagtacatatatgcatgtgcacgcatatgtgtgcgcctgtgtgcacgtgtgggtgggtgtttactatcaagaagcaacagacagccgtgagcctcactcaccccaactagggggtgggaagcccaggggtggggcagatgtttgctgtgagcattactcaagagagagaagatgacttaatggcttgcatttcagccacatcaaaaagccctgcgccaacgttaaaatcacatcccattgccaccagccccataaagggcttccctggacgtgcccgatttccaaagcctaatctttgtagtcacatctccacctctatctgccagtgttggggcccctctggggcccagcagcgctaagacaggaggaaggcacggggctgggggagaaggaacccctagaccctgctcaccactgcccttcggcttttcagccacaccggtgagccccgccatgtcctacctgagtgagtacatgctggcagctgccactcctcccactgcttagagcctgcccctgccacatgtccctccaccgtggctactcactcagctctccgggatgggcagatggacaatgtgccctgaggagattgcggggtgggagggcaatggcattagcgagcgggaaggggaggggaggggcataagctgaactcctatgggggtcgtcgggcgcctcccagggccacttgcttagctcagccctctctccctttgtatctgcagccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagacc

SEQ ID NO: 10205 - DNA, 3038 bp, Homo sapiens
  ENST00000621946
atataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggtggggatagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 10206 - DNA, 1641 bp, Homo sapiens
  ENST00000373298
ataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 10207 - DNA, 879 bp, Homo sapiens
  ENST00000469541
gtcactctgcattcccgcgtgtcgtgccatgttctgtctgttccagctcacaccagctgtcctggagggaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaa

SEQ ID NO: 10208 - DNA, 523 bp, Homo sapiens
  ENST00000482194
agataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcg

SEQ ID NO: 10209 - DNA, 190 bp, Homo sapiens
  ENST00000462038
aggagctccgagttgccacccaggaaaaagagggctcctctgggagatgtatgcttactctcttaggcctttcattcatcttggcaggacttattgttggtggagcctgcatttacaagtacttcatgcccaaggttgtaattttccctttttgtcttttagagcaccatttaccgtggagagatgtgct

SEQ ID NO: 10210 - DNA, 291 bp, Homo sapiens
  ENST00000461357
tcatagtcaggggctattgtggcctggacagaggcagaaagacacgacacagcaggcttccttcctgtcttgctcttatctgaagttgcagagagtgggtgggagtatgcctgaggtgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagg

SEQ ID NO: 10211 - DNA, 1698 bp, Homo sapiens
  ENST00000434584
gtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctat

SEQ ID NO: 10212 - DNA, 852 bp, Homo sapiens
  ENST00000425927
ggggccttcaactctgctcaggagctcgggccggagaaaggccccgagacttgaagcccttgcccgggagggatgaacacgcaaaggaacccgaggaacgggcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaagga

SEQ ID NO: 10213 - DNA, 1824 bp, Homo sapiens
  ENST00000260386
gtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaaga

SEQ ID NO: 10214 - DNA, 854 bp, Homo sapiens
  ENST00000462816
agaccttgaccctgtcgctttcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccg

SEQ ID NO: 10215 - DNA, 507 bp, Homo sapiens
  ENST00000491007
aggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttccctt

SEQ ID NO: 10216 - DNA, 5822 bp, Homo sapiens
  ENST00000272117
atggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 10217 - DNA, 3146 bp, Homo sapiens
  ENST00000366784
attgaacaaacactgaagtagcccggagcagacactgacaggggcagtatctccacggtcgaaaagggcgtgcagggccggcttggcgtcgccactgccgggatcgccgggcccctgaaccgaagagctttcccccctctttcgcactcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaa

SEQ ID NO: 10218 - DNA, 6162 bp, Homo sapiens
  ENST00000429204
cctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 10219 - DNA, 2008 bp, Homo sapiens
  ENST00000566735
gtcgctttaaggcggaggcccgggagggggccgacccggctcgccagctccacgctcggctccagactccggcatttcctccccgctagctggcgcggcctcgcctccccctcggaagaggaaactcccggggtccgagtaacagggtcaggcgcggagaggagcggcgggagagccaggagggccgcccaggctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccaggtgggcagcgcctacgagcaacataaaatccgccggcccgacagcttcgacgtgctggtgccactgcgcctcccgccgcttgtggcgctggagccacggagcctgggcgaggagccagcgctggccccggccttccgcggctgcttcttgtgcgccctcaaggcaccaccctcaccatcgggggcctcggggggccactggcttcgggactgcaaaccctttgctgatgccttctgcgtggatgtgcgcgggcggcgtcacctctctgctactctggtgctgcgctggttccagtcgcatctgcagcgctccttggccactgtgcgttacagcctggaggggcgctgtcgggtcaccttgaccccaggtggcctggaacagccccccaccttacacatcttgccctgccgcactgactacggctgctgccgcctttctatggctgtgcgtctcatccccgctgtccatctgggagatggggtcttccttgtggcgccaccaccgccacccttgcccagcgcgcccctgttggagctccctgagggcctgcgtgcggaggcactgtggggtgtgaacacagcacgccaggagcagaagctgctgagttggctgcaggaacgggcagctccaggtgcctgctacctcaagtgcctgcagttgcttaaggctctgcgcgatctgggggcccgtgggctggactcagcggccgccacccagtggggacgcatcctatcctcatatgtgctcaagacagtgctgctggcagtgctgctgcgcaagggggcccctgggcaaggctgggacgaggagcacctgggaaggtgtttggaggagttggtgcagttccttagggactgcctgctgcgacgccatacgctcttccactgcgtcctgggccctggtggggcggctgccgaggtgggtcccctgcccaaggcactgagggaagccgccccagttgacctcctggccgctttcgacgggcacgcccgggaacttgcagcagcgcggttgctgtccacgtggcaaaggctgccccagcttctccgggcctacgggggtccccgctaccttgccaggtgccccccaccccggagtcagcgcacccagggcttccttgaaggtgaaccgtaaaccctgacagcacccccacctgaccaaatgctcctaaagcctttcccactgggtgggggtgggaatggcggtgaagccagttaaatgcaagattgcagaaggcattggaaaatttggtggctgccacaagctttagtggcttaaatatcaccttctcgcttcacagtccagtataatatgacatcttcacacccactagagtgtcctgggcaaaccatgggaagacatccaacaggagacccaagaattggttcaaatattgttctgtgtagacggattctgtagaaggatgtggcttttagagaagtccagtagaagaagcaagaactagctgcagggaaagttccttctgtcggtttttagacacagatctctctgcccaaatt

SEQ ID NO: 10220 - DNA, 7247 bp, Homo sapiens
  ENST00000381440
ctgtgcgcatgctgggcttgggtcgccgccggggcttgccccctgggctgctcggccaccgccgccccgggcgcccggcatgtcggtgcactacaccctcaatctacgcgtcttctggcccctggtgaccggcctgtgcaccgccctggtgtgcctctaccatgtcctgcggggaagcgggggcgcccgggccgagcccgccgacggcgtggatggcggcttcccgttgcttaaggtggccgtcctgctcctcctcagctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccaggtgggcagcgcctacgagcaacataaaatccgccggcccgacagcttcgacgtgctggtgccactgcgcctcccgccgcttgtggcgctggagccacggagcctgggcgaggagccagcgctggccccggccttccgcggctgcttcttgtgcgccctcaaggcaccaccctcaccatcgggggcctcggggggccactggcttcgggactgcaaaccctttgctgatgccttctgcgtggatgtgcgcgggcggcgtcacctctctgctactctggtgctgcgctggttccagtcgcatctgcagcgctccttggccactgtgcgttacagcctggaggggcgctgtcgggtcaccttgaccccaggtggcctggaacagccccccaccttacacatcttgccctgccgcactgactacggctgctgccgcctttctatggctgtgcgtctcatccccgctgtccatctgggagatggggtcttccttgtggcgccaccaccgccacccttgcccagcgcgcccctgttggagctccctgagggcctgcgtgcggaggcactgtggggtgtgaacacagcacgccaggagcagaagctgctgagttggctgcaggaacgggcagctccaggtgcctgctacctcaagtgcctgcagttgcttaaggctctgcgcgatctgggggcccgtgggctggactcagcggccgccacccagtggggacgcatcctatcctcatatgtgctcaagacagtgctgctggcagtgctgctgcgcaagggggcccctgggcaaggctgggacgaggagcacctgggaaggtgtttggaggagttggtgcagttccttagggactgcctgctgcgacgccatacgctcttccactgcgtcctgggccctggtggggcggctgccgaggtgggtcccctgcccaaggcactgagggaagccgccccagttgacctcctggccgctttcgacgggcacgcccgggaacttgcagcagcgcggttgctgtccacgtggcaaaggctgccccagcttctccgggcctacgggggtccccgctaccttgccaggtgccccccaccccggagtcagcgcacccagggcttccttgaaggtgaaccgtaaaccctgacagcacccccacctgaccaaatgctcctaaagcctttcccactgggtgggggtgggaatggcggtgaagccagttaaatgcaagattgcagaaggcattggaaaatttggtggctgccacaagctttagtggcttaaatatcaccttctcgcttcacagtccagtataatatgacatcttcacacccactagagtgtcctgggcaaaccatgggaagacatccaacaggagacccaagaattggttcaaatattgttctgtgtagacggattctgtagaaggatgtggcttttagagaagtccagtagaagaagcaagaactagctgcagggaaagttccttctgtcggtttttagacacagatctctctgcccaaattaaaaaaaaacaaaacaaaacactaaagtttttgacacaattacttgctaggtactgggttcctgattgtctttaaaaagaaaaatctgaatctttatttgcaactggaattgaagttctattttaggggctaatgtttagaggaacataatttccactgttcaaattaatattaatgtatttttaaaatggtgcaatcacaggtgtttgacaagattgtcaacaagttaagtcacatagatggaaaggcaatcgagagttggttagagaagcttccagagaaaatagcactttatattgatcaattcactcattttgtggtaattgctagcaccaagcattgcatctgaaagggaagccagttatatttattattaaatgtacaaccttgaaaagcagccagcatgcttgcctaactaacatcgccgcaggccacaagctgggatatgtacctgtccgtcaacatccattcattaaactacctactaccagccagagatgtctggaaccaaagtagcaaccaaatacatattcaagacaacactggtgaaggcataaaacatgttggctttggagaaagatgtgttttaggctttgcctgtaaaggtgtttctccaaggctggctgctggctggagacagaaaacttttttgttttaaggtttttagcaaactccttcacaaagagatttctttctgagcttaatgagctaatgaagaggaaatgcctgctgcttagcatgtggtttgtgctgggtctctaaccattgatggttcttccttgtccaggcagtcttacgtggtccaagagacctgttgattcagcacaggtcttgcaaaacatttcacttatagttcagtatcttgggctctgtgcttgaagatcagttactccctggtcgtgggcagaggagacaaattaggaaaagagcaagggagacagcccttgacggcagtctgtctcttttctctttaggtgtcagtatcaccaggttgggtgtattttgcagctgggaggagccggtcctggaattcttccttgttctcccaaatttataacagtcctcaattgcagtttaagttcagcatggcccctcatctgcttgcctgattggaaatgcagccagtccaagtgttacaaattgggatttttttgttttctaaataaaaacatgtacttcctcagactcttaaagctaaaatttggaagacagaaatgcctatgtgaatagaatcattgttgaagttctgagctcttttgagggaactctataagccttctttctttaggggatccacttgcctgctgtgggaaatcatagtgagtgatttacaggaatccttctcctccaagctgcattggcttcttatatcctttgcgaccttgggctgaaagagaaacagctgcaaatgttgtgctgtctctttgaggttgtcttggggacagttccccgcaaaggtcattcctagcttttgaggtcaatgttgggtcataaggtactgcattgtgcaaagaagtcagtctgctaactttatgcaaagatagaaactgcacggtattttttaaaattagtttttaaaataaatgccaagagtagatcttatatatatatatatgtatacatattttatatatatatatatttccatactcaaccacaacttcctctgtactcattgtttactacagtgggggacatcaagggttggaaggattataaagctttaaggctgggcgtggtggctcacgcctgtaatcccagcactttgggaggcgaggtgggcggatcacctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctcaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgcctggctaatatatatatatatatatatatattttttttttttttttttagtagagatggggtttcatcatgttggccaggctggtctcgaactcctgacctcaggtgatctacctgcctcggcctcccaaagtgcagggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaa

SEQ ID NO: 10221 - DNA, 2035 bp, Homo sapiens
  ENST00000478720
aacagtccatgctctaccctggctcctgtctggcagaggagacagacattacacacgatttcagacccagcaggctgtgggctgctcataagcgagggatactggatgcagaggagggaagggatctgggaggtagatgtgggatcagacctgcatcttgaaggatgagtaggatgctgacgggcagagaaagcaggcagggcagaaagagcaagcaggggcttcctagcaggcaacacagcctggggaaaggcacagggcagccagatgctgggctgttgggcccagggcagtggcagatggggacagggagccggtagtgttatggttggtttgaaagacagggtctgcatccttggagaagagattaatgagacttgtcttcctcttttgtagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatggtaagtgtcgctcagccaggggatctaaaggctttcccagtttcctagatcctggagtccagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgattttataaagaagaaagacttctgactctcctgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 10222 - DNA, 5814 bp, Homo sapiens
  ENST00000361999
cgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 10223 - DNA, 6300 bp, Homo sapiens
  ENST00000355123
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 10224 - DNA, 974 bp, Homo sapiens
  ENST00000427234
aggaactgcacggattcctcttcaatgacttcctgcttcttacctacatggtcaagcagtttgctgtttcctctggctctgagaaacttttcagctcgaagtccaatgctcaattcaaaatgtataaaacggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccacc

SEQ ID NO: 10225 - DNA, 252 bp, Homo sapiens
  ENST00000449392
cgcctgggtgcagaagatcaaggcggcgtctgagcagtacatcgacaccgagaagaagaagcgtgagaaagcttaccaaggtttcccccattttgttatatactcctaaaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccagg

SEQ ID NO: 10226 - DNA, 749 bp, Homo sapiens
  ENST00000479575
ggattgtcatcttcctttctcctaaggagagaacactgggattttttgttttgagttctttgaattcagctggtagaatcagtgttctgtggctagaagtaatgattttcactgggccagtttggactctgaagagtaatgtatttaaggatctttcatgcaaagtgaatgattctagccacattcccacctagaaaactccaccacagtatcctcaggcccagggcactggcctctcaggggcactggatggtttgtgccgggatttaaaaagtgaaattttctttctctttaagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgc

SEQ ID NO: 10227 - DNA, 4563 bp, Homo sapiens
  ENST00000406921
ggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatgagagatggtgggcatcagactcagggctgcctccacgcagagtcaaagcaaggcatcacttttgatgtgtgaattcacaaatagtgacggaagctctcacatcctccaaatgctgtctctgcctgccggataatgcttgagattgaaagtctctaatgagctctttcccccagatgaggtcactcagagtgaagcgggagaacaagagggcattcgcatggcttcgttggatgtggcaggagccccatcaaggaaggacggggatagagtggatgggaagggcctatggcagaccgtagcttccttggatatttgcctaatatctgttttaacatctgacattttcataaactggtatctctggaggaactgtgaaacagtgaaagtgttcacctcatggttgtatcagtttggaaaacccaatgggagcatattgtaaaatagttcccaaatatcatatagctactgtttgtttataccagtgacctctacgctgatgacagctatccttattcgagtagcactttaaaatgatttgtgcttgagtgaacaaaagaagactttccatttctacta

SEQ ID NO: 10228 - DNA, 3634 bp, Homo sapiens
  ENST00000416160
gccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatttgtttaaaggccaagaactggaaacagccatgccctgttttctgtgtatttgggatgggaataacaacattttgggggagctttttaaatctcagagaagaggaaagtggcctgctctggcaggtatgtgcagtgtttcatttgttccagtcccaagaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgtgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttataatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcacttcacttttacactgataaatataaattactgggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactata

SEQ ID NO: 10229 - DNA, 2066 bp, Homo sapiens
  ENST00000412011
gggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtaggagctggagctcaggtagtagtgctcactcacctgccactcaccgagccccgctgtccagcccggttcctaacagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaa

SEQ ID NO: 10230 - DNA, 563 bp, Homo sapiens
  ENST00000469848
tgtgacttggaaattatggaaatcaagcaacttcaacaggaacttcaggaatatcagaataagcttatctatctggtacctgagaagcaattattaaatgaaagaattaaaaacatgcagttcagtaacacacctggtaagtctctaaggtttgtctgattacttttatccttttctgaatgactgtatcagtcacattgttacttttttaaaattaaaaaaagtattctgttataaataacactttttgcctgtaagtttaaagtttcaaaataaagtgaaaaatatcccagatgttagagcatttttagtgataaaaagtagataaaaataaaatagtaatgattgtggtatgacttcatatcttgatgatatttttatgtatataattgaaacatcaaataaagtgttagactataagatataaatttggctctaacacaagactacatgtgcattttgaaaagtcctgcactgattttaaagaactgttcaggaggaggctttatggtggggccgcacctgggattctagggtgttagcgtgcagcagtcataggctta

SEQ ID NO: 10231 - DNA, 902 bp, Homo sapiens
  ENST00000443927
ggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatgaacctattatttaaggattaatgttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatggg

SEQ ID NO: 10232 - DNA, 597 bp, Homo sapiens
  ENST00000407704
gacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggcaatttcttataattatatgtgagaagcactcattttgaatg

SEQ ID NO: 10233 - DNA, 5805 bp, Homo sapiens
  ENST00000622089
cagatggctgagagccaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatg

SEQ ID NO: 10234 - DNA, 6048 bp, Homo sapiens
  ENST00000254958
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcc

SEQ ID NO: 10235 - DNA, 3758 bp, Homo sapiens
  ENST00000423891
attgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatcta

SEQ ID NO: 10236 - DNA, 580 bp, Homo sapiens
  ENST00000617357
acacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaag

SEQ ID NO: 10237 - DNA, 1161 bp, Homo sapiens
  ENST00000488480
ctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagagtgagtgtcctccccccttgaactctcccagggctgtcggagcagatcctgacacccttggggacttgcaatggaaaccagaagcagagctgtttgatgtctgcttttgtatcacctgggtctgcattaatgacttgatgggatacagccctgacctgggcatgagaaagtcgccaataagataagtggagacagatggcgtctcagttcccagctctgggtctgaccagcagcctgtctccttccattctcacccccacccctatcccctaccagggcctcttcctgtgtacatgtgtcccacagcaaatgaaactaagtgtggtgcgggcctggttccaatttagcaaaggtattttgctggtgttaactacgactttatcatttgggtattaggaaaataagtggtggttttactta

SEQ ID NO: 10238 - DNA, 586 bp, Homo sapiens
  ENST00000612857
aaatgctttaaaactctttgcctggagtctcaactttgcctgtcataatgtgatgtggcacgttgccagtatcttggcttccctggggtgtgtctcattagccagagggtccctgtctccaggaaagtgggcttggcccaggcccttggcttaggaatgccgcatctgtgggtgcatggctgtgatctgatcccaagcctatcttctagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaagga

SEQ ID NO: 10239 - DNA, 597 bp, Homo sapiens
  ENST00000613518
gccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaa

SEQ ID NO: 10240 - DNA, 507 bp, Homo sapiens
  ENST00000622545
gtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcgg

SEQ ID NO: 10241 - DNA, 756 bp, Homo sapiens
  ENST00000620743
aagaatctcattgccagctactactgcgactgtcttcccggctggatgggtcagaattgtgacataaatattaatgactgccttggccagtgtcagaatgacgcctcctgtcgggtatgtaaatctttgcttaaatcaaaactttgacaattgacaacaaatctttagatttgtgcgacactaggagagctctgtccctgtgagatttaaaaatttgggtgaaaaaagagtctcttggaagtttcgctagggcttatgttaccccagcctcgtgggagtcattttgaaggcatgcacatagaaattcctctaaccactttcagaggtttagcatttggctatttcagtgaaccagctaaaccgcaacagtcatgctaaaccgctgaagccctgtgtttgtggaatacatagaaaaaaagcatgtgtctctctctccccttctcctcttctaggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccact

SEQ ID NO: 10242 - DNA, 837 bp, Homo sapiens
  ENST00000617965
gtctaccttcctgtccccagaaacaaaacagaaaaagcctggactttgcagtcttccatttgaattgtacaggtgtctcttaacgttcaaaaggctaacctggaggtgtgctgtgtgtctccaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaagtaagtccaattttcagcctgtgtccattctaaggatccttgtgccaagataccacgctggggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggat

SEQ ID NO: 10243 - DNA, 1757 bp, Homo sapiens
  ENST00000400532
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattc

SEQ ID NO: 10244 - DNA, 4337 bp, Homo sapiens
  ENST00000480456
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacactaataaaaata

SEQ ID NO: 10245 - DNA, 1025 bp, Homo sapiens
  ENST00000460679
aggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccaatctggcagacctaactttggctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggtctctcagtctcgaagagtaattcttcatctaaagccacgacaatgagtgaaaatgatttcaagcacacaaaatcctttataatttaaagactccactttagagatacaccaaagccaccgttgttacacaagttattaaactatta

SEQ ID NO: 10246 - DNA, 946 bp, Homo sapiens
  ENST00000492962
tactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagtaagtatactttcctacaatgcatgtctttctcctatgtcaactaattttctattaatcatctgtttaaagtcaaaagagagaagttgggttatttgtgtaggtttactctcacaagaagttactcaagtttatcaagaaatacatctgtattaggctgttcttgcattgctgtaagaaaatacccgagactgggtagtttattgtaaaaagaggtttaattggctcacggttctgcaagctgtacaatcctggcaccaacactgcttggcttttggggaggcctcaggaagctttttactcatggctgaaggcaaagcgggagcaggcacgtcacatggcaaaagcaggagcaaggttggggaggtgccacatacttttaaacaaccagatttcaagaaaactcagtcactattctgaggacagcatcaagggggcggtactaaaccattcatgagaaatccgcccccatgatttaatcggctccaacaaaccccacctccaacattggggattacaattcaacataagatttgggcaaggcaaatatccagactctatcaacatcccacttcacacttcatacctacttgtaaatggtagtacagagagaatgatgattacccagcctacttgtaaatggtagtacagagagaatgatgattacccagacaagaaatatggtcactaatttgatttcataggcatttgtataaactaacttaaaaaa

SEQ ID NO: 10247 - DNA, 311 bp, Homo sapiens
  ENST00000477351
ctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggaagagtaattcttcatctaaagccacgacaatgagtgaaaatgatttcaagcacacaaaatcctttataatttaaagactccactttagagatacaccaaagccaccgttgttacacaagttattaaactattataaaactc

SEQ ID NO: 10248 - DNA, 614 bp, Homo sapiens
  ENST00000471689
aaaatattaaatgttaatatattaaattaaaagttagtaagtctctggtttgtgtattccacaaaaatctttagtatactagccacaagctacatttacgtgcacaaggcttcacactgatgttttgttgcatgactttctctgtgaatattgtctgtaaatataagaaattcagtaagaattgtctttttttctacctaagatatatgttcatgttcttgctgagaaaatgtatggaagtaaaattaactaaaagagcatatatgttccagattggaagtgataatgtagtaaatattgtcttttatattccacaaacaggaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctgga

SEQ ID NO: 10249 - DNA, 4209 bp, Homo sapiens
  ENST00000312957
gggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacact

SEQ ID NO: 10250 - DNA, 3912 bp, Homo sapiens
  ENST00000299106
tagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaacattgcttcattctttgttatttgctcttacgttgggtttgtctcttcttcctagcatttcagtggttaggcatgcacactaaaaatgctatcaatcacccatccaccagggaagtcagtgctgggcaggaggtcagcctgtgtgctcaagagcagtgctgcgcctctccgccaccgagcccacctgtgttgcggttcccacttgggatggcagtgggcagatctcagtggcatcccatcccccaaa

SEQ ID NO: 10251 - DNA, 564 bp, Homo sapiens
  ENST00000532252
agcaaccctcgacatggcgctgaggcggccaccgcgactccggctctgcgctcggctgcctgacttcttcctgctgctgcttttcagggagtcaagtctagtctgctttccaaggctgcattctaagtagtgaagcctcaacttcatatttacctaaagcaggacaccacactcttcccctggcagccatccgcaggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaag

SEQ ID NO: 10252 - DNA, 385 bp, Homo sapiens
  ENST00000534549
agcaaccctcgacatggcgctgaggcggccaccgcgactccggctctgcgctcggctgcctgacttcttcctgctgctgcttttcaggggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattcc

SEQ ID NO: 10253 - DNA, 3363 bp, Homo sapiens
  ENST00000441717
agcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcaggtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccc

SEQ ID NO: 10254 - DNA, 1048 bp, Homo sapiens
  ENST00000531302
tggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtaagatctcttctaagaggtgaggatggagatgtctttgttggggcaagagatgcttattgtgaaaagaagattaggagagatactgaaacttcttgataagacaggagtcaaaaatctagaatgttagggattctacaggaaaaatgacccttcttccttttataaacaagtacattcttagggggtaaaataaggaagagaaagaaaccatagattgagaccgaagagggatattaagcaaatgttactagggccctgatcggataatcaactgtaaaagtcattagacaatcggggaaattggattactaggtggtatttgatgatctattaagcaactgttcattgctttaggcatgatgaaggtattgtggttacgattttttacagtcttgtagagatactgaagtatttatggataaaaggtgtttgga

SEQ ID NO: 10255 - DNA, 678 bp, Homo sapiens
  ENST00000524969
atggatggccacagtgcgctccatccctgccatctctctttgtcatcctctgtcttgcccatgctgcagtgccttgcagatttgtttatatgcatgactttgtcatctgttgctgagagctgaggaaaacctcctgactggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggt

SEQ ID NO: 10256 - DNA, 660 bp, Homo sapiens
  ENST00000532165
tctctttcccttggctccttccagtgaaggtcagatttgagagagaaagcagttaacttggcttacctaagagactttattgtggaatatttttccatcctctgtggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtaagatctcttctaaga

SEQ ID NO: 10257 - DNA, 997 bp, Homo sapiens
  ENST00000533711
tttaagtgtacattcatctttgagaaccaatacactaggataaaggagatttttttaaaacttccaagttacttggctcttgttgataaattccctgcatagttttccatgtgtcgcttgcttgaaggaacggctgccagagccccatatgaaagtgacccagtgcctttgcccagtgtatagacatgagaaaagggttccagggggtttcctctcagagggcttatagatcggaggtcaggcagccggcagagacaaagctctagttcttacctaggattctttacttgtttgttttttgagacagattctttaaggcttgaagctacctttcttccccgcagcaatctgcaacaaagggaggccctggaaattagggattcttttcttcttgggatcctggctcctaatcttgtcctcataaccatttcctccataagtaatctcaggcattcagccagaggatttttaagcctacagtgccaagcccactttaatacacttttcagtgcgactgcatttcaactgtagaagtctcagtacttttcacgtgtgaagttaggagttatggtgtcctatatgttctaggctagaaggattgtaagtgttctctcttctagctggggtaggcctgagggggcagggggcaagtgggtttggggtgaaggaaggaggcacagcagggccagggcctttttaaataacagatagtgtgtatcatggcttccaccaaacctccttttcttcagatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcaca

SEQ ID NO: 10258 - DNA, 1485 bp, Homo sapiens
  ENST00000529164
agttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaagtagatgcaggcctgggccgttctcatacccccgggaaccatatcttacccattgtatgtcgcagcttgcaggccagtgcttggcacagagcagggactcaggaagcctttgtcactaaagtaagagcctctgcggagtacagtgcatggggtcggctgggacagccccaggcagcagatcctggtattgggctgaggaaagagcactgcgcttggagtcagtaagatctgccacctccctgagtctcatcagcaaaatgaggataaagataaagatactatagttgcccagcctgcttgacagggttgttgtaaggttcacataagatgatgatatgcaaatgctttgtaatctagga

SEQ ID NO: 10259 - DNA, 623 bp, Homo sapiens
  ENST00000531536
gagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggtaacaaggaggaaacatcactgtgttagagaaggctctggctgatggtatcaggacaaaggtagaatcaggcacatgaggaggtgttgcaagagcctgggctttggtgcttatcagaactggaccttctcctagcaatttcagctttctggtgggaaagataactccaatgaagaacaagaacaagaagatgatgatgatgcttaactttttggatgccgat

SEQ ID NO: 10260 - DNA, 591 bp, Homo sapiens
  ENST00000524477
atcagaaaggagagacttctggggtttcccttatttctttagaaaggttgggaggaagaattccagaaaagtgtaaggggctggataggaggagggagccagatagcatttattgtagtatgaagattgcagaatccttctgatgagccatatagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcac

SEQ ID NO: 10261 - DNA, 547 bp, Homo sapiens
  ENST00000527877
gtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgt

SEQ ID NO: 10262 - DNA, 574 bp, Homo sapiens
  ENST00000525565
gtagacctaaaaacatctgagagcctagaagtgcacagcagtgtgcagatagattgagaggacttggctctgcaggtggacaacactctatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgt

SEQ ID NO: 10263 - DNA, 951 bp, Homo sapiens
  ENST00000640745
ctgtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaaagtgg

SEQ ID NO: 10264 - DNA, 2624 bp, Homo sapiens
  ENST00000531530
gatcctgggggccagggtgaagggtattttacgggaactctataaagcaggaagaagcaagtttattctttagaccagtagctctcaaccatgatgtggtcgtatatttatgggtcaacatgtgttgtggggatatcccaagtaacttgttattaataaaagttaagttgcaaaatttagtaaagactaacttttataaattaaaacatattccaggtcatctctctaacaaagtcatttgcacttgattcctctatgctatctgagtgggtcacagtgggtgacatcatgatggagtatggggaattacatctggtcccaggttcacctctgagagcttgccatacatttaaatgtcatccattgagtgattcacaggagaaaataggatgagaattgacattttgaggttgtgaatttgaatcacgagagacaaaatgttaggggccaggtcacttcattcatgtttgtgtctacacacccattaacttttcttaaaagctttaaaaaagcaatctacatggctttttttaatgccaatattcatttaacaagttatttttaaagaatctgctatatgaagaatacttaaagccccagtcctgatgggaaacttacaaccaagatggaggagatacatgtaaaataataaagacgtatataatacatcaggcaatagtaagagcctacggggaacaataaagcaggactttgtggtttttgttatgtgggtgcttggggagccctcactgagatgacatttgaggagagggagtgaaccctgcatatgtgtagggggaagagtgttcttgcagtcatagacagtagcaagtgcaaaggccttgcagccagtatgcaaggagcagccaagaggtccatgtggctggagcgcagtgacccaagtaggtgagggaagagcaagtagaagttgaagtcagaggtaaagggagatgggctgggtcatgcagggccttgcattttagtagaaatgggagtgggggccatgaagggttttgagcacaggagtaacatgatttaacttacatttttaaaggctcatctgctgaaaatagattgtcatagagaataagcagggagacaagtaagaaagctgttgcaggaatctaggtgagagatgagctggaccagaatggtatcagtggaggaggtgaggactggctggattggggatatattttgaaggtagaggtgataggatttgctgagggattcaatgtgatttgttccagaaagacagaaattaaggatgactccaggatttttagcctgagtatctggaggaaagcattgccatgtaccaaaatgggatggactggaaagaactggtttgggggaaagatgaagagttcagttttagacatgtttcaggttcctattggaaatccaactagaaatgtcatcaagaataaaagtatacttttgctttttttttattggaaaggtgcacaaaatgaaagtcctccttttcttatccctccattcagatggaaaaactgttcatggttttgtgatgtccttcacaagtacacacgcatgcacatgtgtgtgtacatgactttgtgttatttaatgctttctgataatacccttactgccttcacctagcagggccttggagtcctgagatcttccctcccccattttctctgctccccgctccactccagtcctcacaatatcatactttttgtctttcacttctaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaac

SEQ ID NO: 10265 - DNA, 1383 bp, Homo sapiens
  ENST00000526620
gcagtctttcagttgagcttggggactgcagctgtggggagatttcagtgcattgcctcccctgggtgctcttcatcttggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcag

SEQ ID NO: 10266 - DNA, 1935 bp, Homo sapiens
  ENST00000526595
acttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagatttaagagcaaggaacaacccatttcgtcgttatgattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaaaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgag

SEQ ID NO: 10267 - DNA, 1944 bp, Homo sapiens
  ENST00000356289
ctgtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatttacagttagaaacttttggaaaaactgaagttcctggaggaaagccaaaccgtgctaacacactagaggctggttttggtcctgggaaaggtttggggtgaatgggttggaagtagggtatgaatac

SEQ ID NO: 10268 - DNA, 1959 bp, Homo sapiens
  ENST00000292067
atcacttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagatttaagagcaaggaacaacccatttcgtcgttatggtaagtggagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcatt

SEQ ID NO: 10269 - DNA, 5610 bp, Homo sapiens
  ENST00000534294
gcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaagtatctaacatttggctggggagcattgagggacctcctggctggtgcatggcgccaggactagagtgaggccggagaggttcctaggatgcaaaattgaaggaggcatccctctcaggtgctgactctggccttgcacaaccctgagaatgatgcctccttagaggtggctcctcaggtgcctggcttgcctcaccctagttctggccctgctgctaggccaaggggaggggagctaatttagtgaataccaatcctctgccagaccccactcattgccagggtcatctactgatgtaaagatacagaagctcagggaaggatcggagttgatgtccaaagtcagcatacttggtttcaagggaggtgctgtatgtgttagagtggagcgggaaatgatcctaagctagtgagagacagccaggaacagagaggaacatgcaggcaccagaaccaaaaatggagggttttctgatcagaggttctggattctggcaaacagtgtgcatcaaggccagtgctgtgtaggagaggaaagacttgattgtgttgacagagagaggttgataagtgaggggttaaagttaaaccataacccagttagcaatcaggatgtggcctgtggactttgcctgtcgctagggccttcaggagttggctgtggttggctgggggtggggaagatggggtgaggatggaacatacctcatacctcaggccagagacctaagtctgtggaggcaccttgtctccagctggagaggggagcacggcaggtctgtgtgcttccttctcagaagtccaattcacagagaaaatcgagccattatgggggctcatgcagcttctccacccacaaacatatctatgtctcccccattcttatctctgccctgccatcctgaggcagaggaaggtcccttctgctctgggcttatctggccccctgtgcccaggtggtatccttctcaggaaccttacaacatggctctttgagctcactttctgttggtttctaccattcaatggatacgtttgctcaattctactacttaattactccagctccattctatgtctttttttcttcagctccattctgtgtctttctttttcttaagattgttttcctgagatacaattcacataccatacaatttgcccatttaaagcgttcagctcaatggttttagtacattcagagttgaacaaccaccaccacaatcacgtgtttctttctcaacatagccaaatagcttgctaaaggtctgtgtttggtatcttactgtctcatctcccattaactcctcagtgcactgcattctggcttattctacctctactccagcttagatcaccaatggcactgcaattatccatcctcagccttctctccttcagtagcatttatatgcactctatgttggacacagttccacacacacccatggatatacttagtcaactctacacaagttttccacaaatccttcatatgcaacatgtctaacctacccctgcacacccctcctcagcccatctccccaacctcagttgtctaactagatgcctgggggtgtgcttgattctttccctttcctagacccctaatctaacaggtcaggtcaacaagtccttgactcctactacagactcttgaagttgtcttccttccagtctgtcactgccgccttagttctggctgtcttcatctctgtcttgaactgtaggcctctaaccagtctctgctttctctctcagccactgctcctcattcttcacgcggctcttggtgccatctttctaaatcacattaagaactttctcttccactgctaataatctttcaatgttgttttcattgcctgcagaaaaatgccagattcttggttgagatagtcaaggtccttcctgacttggaccctgtcatctctccagcgaaattctccagcacacccacaaatgccacttttgtgccagacccgttgaactctttctagtttctaaaatcatcatcctgtcaggcctccagatctcatgcagaacatcccctctgtccttctccatattgtcttcccaacaaactggatgtttcctgtaagtcttaggttaaactttagaacttttgctggcaaattctcacttgctgcatatagaattggacacccttttttctgtgcccctctgttccccatacagacttctgttgtagcgcctacagcagcctgtggttttctgttgacgtgtttgtcttcttccttggaagcagggaccacacatcatcattcatctctgaatcccctgtacctagtgctgtctggccctgaggaggtgtttgctttatgtatttagaaagaaccatgcagatgagtagaaggttccatatgggcagaagtacctccggaggctttacttggtatcgtcactgtggggctgagtcttgcggcatgagttcttttgaagacaaccacttgccctaaggaagatcagcagcctctcaaatgcctgttatttctgggtccttgttaagccaaattttagaatagaattgttgatgtgaaaggaaactttactagaggtgaactgctagcctcttctcccacccaccttaatctacattttagggtaaacgagggggttagactttggttctcaatctcatggagacagtgtccctagtgtccagatatggggtggagtctggccttcccctccgcttcgtggcctggctggtgctacttggtatagggctgtggggctctcagctctttgctaaagtattgagaccctctccttgcttttctactttcccaagcactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaagtagatgcaggcctgggccgttctcatacccccgggaaccatatcttacccattgtatgtcgcagcttgcaggccagtgcttggcacagagcagggactcaggaagcctttgtcactaaagtaagagcctctgcggagtacagtgcatggggtcggctgggacagccccaggcagcagatcctggtattgggctgaggaaagagcactgcgcttggagtcagtaagatctgccacctccctgagtctcatcagcaaaatgaggataaagataaagatactatagttgcccagcctgcttgacagggttgttgtaaggttcacataagatgatgatatgcaaatgctttgtaatctaggaggtgctatttgtctaaagtctaatggagaattataatacatccaggagttaaggagttctaatgcttaaaatgaaatagtctaagatcttagcaagaaaggattaagaaggacttttctctccatattgattttgtaatggagttataaataattgcttctagagactgagaaattgattggttttctttaactcctattctttcttttctttctttaattttaaaaaaactctttgaatagttacctttctctattttgggctgtttttgtcccaagagtaggattttttcccagtagagtgcagtggtccaagaatgggccactggatgatactgctttaccaacgagtgacaggaccatgaacctcacagttgtgaggttcaatgagggctggccctgccacataaatcctctgagggagatgatgacaattcactgctgattaatgccattctgcctttactgtaattagaaggaaataaccccagaatacaaggaatttagcaagataaggaacccctgctgctacctaaacatccatctaaacaaagatgtttggcttttgaagcaaagagtttggttcttaagactgtgttctttgacagttaattttcaagaagactgaagactgaattatcattgttgagaattctctaggtctcagtaaccctctgaaccagcagtttgggtggtcgatgcctagcaaataggagtgggtggccttttctctggtgtataagattcatctaatttttaggaatttttgtaccattttccccctctagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatca

SEQ ID NO: 10270 - DNA, 1508 bp, Homo sapiens
  ENST00000533261
ttaagatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaa

SEQ ID NO: 10271 - DNA, 2919 bp, Homo sapiens
  ENST00000427814
gttactttgtgttaggtagcctcatatattctgatgcaaaatctaaaaaaaatcgtaattgtgtttttattacagatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaa

SEQ ID NO: 10272 - DNA, 3125 bp, Homo sapiens
  ENST00000283928
atctctctcgccccctctccctccgtcccgtcctcgccgctcccctcaccccgcctctctccccctcccccagcccctcctctcctcaccccacccggcctccctccctccctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaa

SEQ ID NO: 10273 - DNA, 578 bp, Homo sapiens
  ENST00000466516
agtcagggccctgcgctcctggtgagtccgggctctgttcacaaagctggcggcttggaggaggcagcccctgcattctcctgtgctcctctctggcagttgacctagcgggaagtgccactgcccacaagcattccatcaacttgtgagtttcacttctttgccaaaaactggcagagagaaatgtgacagggaattgaacttaggcgtttcatttgctggaagctgaatctcaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagc

SEQ ID NO: 10274 - DNA, 571 bp, Homo sapiens
  ENST00000430432
taatcagctgtaagtgccgtcactggatagaaggtccgtccttgggtctgtatgtgggtggcaaatgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaac

SEQ ID NO: 10275 - DNA, 585 bp, Homo sapiens
  ENST00000447620
aatatttataagggggattgtgcaagagtttgtgtgacagatggacattttatcactgttgatgtttggaattcccttgaaaaatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaa

SEQ ID NO: 10276 - DNA, 564 bp, Homo sapiens
  ENST00000452993
catgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagggacattgggcatcagatggagtcaaggctgaaccgatctactgtagcatcctgagaggcccctgtgtggaaatgaaagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagct

SEQ ID NO: 10277 - DNA, 562 bp, Homo sapiens
  ENST00000420835
aaagaagccttgggtgctggagaagagatgctcagccaaggctgcagaggcttcagccactagcatggatgcagttgggagggacaaatgccagtgtcacattcatcagcagttccttcgctcacttctacctctactgagaacagggagcttggggttgagaaaacgtttgatgcttttgaaatgctgagaaatgaagacatggttgttgtacgaatatgcatgtccatgcctgccgtaggacaacatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacagaaaatgagatcatcaccccaggaagatgtctgcactctcatgttc

SEQ ID NO: 10278 - DNA, 503 bp, Homo sapiens
  ENST00000454041
ctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagacagcggagatgagacagacctagagaagacctcccttctcgctgtcctacttgtccaaaagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacagg

SEQ ID NO: 10279 - DNA, 972 bp, Homo sapiens
  ENST00000419727
cctgctttctcgagcgctcctgcaccgtggggtggcggagccgggggactgcatggaacccgggacgcccccgcggggagaggagcgcgagcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctggg

SEQ ID NO: 10280 - DNA, 558 bp, Homo sapiens
  ENST00000559773
gcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgaggtccaccggcaacatggactcagagttgggaaactgagtcctctcctgggtgaggctcatctggctgaacaactatgaagccatttaagtctgttttccttctactgtgcccaaaaggcacaaggcaacctggcctgaggttggagcatggagatctagaggaactcatggatggattcaggcgggatgtgaaagtgctgggagtgagggcctgggcctcctctgggtttagccacccttccaggttgtgtacaacctgccatatgctggggctcattgactgtgctctg

SEQ ID NO: 10281 - DNA, 631 bp, Homo sapiens
  ENST00000559060
ggacgctcggcggccgcgacggggggcgctggcggcggcggacgctgcagcggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccg

SEQ ID NO: 10282 - DNA, 454 bp, Homo sapiens
  ENST00000558068
cggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgaggtccaccggcaacatggactcagagttgggaaactgagtcctctcctgggtgaggctcatctggctgaacaac

SEQ ID NO: 10283 - DNA, 5401 bp, Homo sapiens
  ENST00000435893
gccccagcccagccccgcggggaggctcccgcagcccagggacctcgagctttccccgcgccgggcgctgcagccgggcccctcccgcgaggcgcccggcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggtaattattttgtcctctgttagtgtcggtagttattgatatctacatagtacaggttatttaaatatgttttattctgtaaagatgggctgccaagtttgtgttctgaccctgtacgtggtccctatggtgtgatgaatgcctgggatcgcagactcctggatctgttcagctcctgactggtcacaaccagccatgctggatgcatcattccctccctgggcctcagtgtgccctcctgccaggtggtcacacataagacctgtgccacctctgcccagggttcctatgagaatcaatcgagttgatgaatgcaaccatggcctgagaaagacaagacgctttagctatcagatgggcagaaacaagtatgtgttggtaagaatatggattaaaggttgggaggccaagatgggtggatcatgaggtcagaagattgagaccaccctggataacacggtgaaaccctgtctctactaataatacaaaaaattagccgggcatggtggcacgtgcctgtagtcccagctactcgggaggctgaggcaggagaatcacttggacctgggaggtggaggttgcagtgagccaagattgcgccactgcactccagcctgggtgacagagcgagactccatctcaaaaaaaacaaaacaaaaaaaatgtggattaaaggaaacttagatatgctgccagtgagaaactgtgcaaagcaatttggaaataaccagtaaaactaaagctaaacgcatcctttgacctagcagttttcctcctagtcttgggaggaactctagcacaggggcaaaaggaaatgtacaagaatgttcactgatggctttgtttgtatttttaaaaagttgaaaacaacctaaatgatgatcagcataagaacaaataaattgtggtattttcctaaaattgaatattactcaacaggtaaaaaagaatgaaccagagctatatgtatcaatatggataaatctcagaaacctactgttgagatggagggtaggggagtgaactgcggaaggataccacttatgtcatatttctaactaaatgtatacgttgatactttattgtttatggctacacacacatctgggtaatagaggtataaaagcctgcacaagaatgctgtcaatatcacaatcagtcatagggagtgctcctgggagggccgcggagaggagggaactagggatgccactgcaagggtaagtaggacgctggacttcaacttcaactatacacataacatttcatttatttttttaaaatccccatcaaatgtagaatgacaggatttttcagaggtgggtgatgtgtgcacagatgtgggctatcttctccacactcctctgtatatttgatattctttgcaataaaagagaacaagccacaatacaaa

SEQ ID NO: 10284 - DNA, 1700 bp, Homo sapiens
  ENST00000267569
ctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacata

SEQ ID NO: 10285 - DNA, 3775 bp, Homo sapiens
  ENST00000437176
cccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggt

SEQ ID NO: 10286 - DNA, 1726 bp, Homo sapiens
  ENST00000261247
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaa

SEQ ID NO: 10287 - DNA, 562 bp, Homo sapiens
  ENST00000554754
aaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatgggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgct

SEQ ID NO: 10288 - DNA, 611 bp, Homo sapiens
  ENST00000557560
gggaggcggagccgccgagctcgctgtggcccggatgttcggtgcagctgccagatccgctgatctagtgcttctcgaaaaaaaccttcaggcggcccatggatttatagcgcccgtcacaaagggcaggaccgctgcaaaaaaatggaatcttaaaactttagccatcgttcgctaaaggaaatgaaaggagaaattcaacagtcgcttggagcctgggttttgcttactgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggta

SEQ ID NO: 10289 - DNA, 1636 bp, Homo sapiens
  ENST00000425728
ccgccgagctcgctgtggcccggatgttcggtgcagctgccagatccgctgatctagtgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctac

SEQ ID NO: 10290 - DNA, 570 bp, Homo sapiens
  ENST00000553156
gttcggtgcagctgccagatccgctgatctagtgcttctcgaaaaaaaccttcaggcggcccatggcataaggagaaggaagtaaaaagtctgcttgaatgtgaaaggagagaaggcactgtagaccaggcagtctagattgtgaattcgtgaataatttgggaaatgattgttcaagaatagtcaaaagatgcataatttttcaaattaattcacatgtagaccgcagtttgttttgagacggagtctccttctgtagcccaggctggagtgcagtggcgcgatctcggctcactgcaacctctgcctcctgggttcaagcgattctcctgcctcagcctccccagtagctgggactacaggcgcgcgccaccacgtcaggctaatttttgtatttttagtagagacggggtttcaccattttggccaggctggtctggaactcctgacctcatgatctgcccacctcgacctcccaaagtgctgggattacaggcgtgagccacctcaccgagcctgtttgtttgttttaatcaatgaatgaatgaagggaatcagatgtcactgatg

SEQ ID NO: 10291 - DNA, 619 bp, Homo sapiens
  ENST00000555491
cggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtaca

SEQ ID NO: 10292 - DNA, 592 bp, Homo sapiens
  ENST00000556985
agctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactgtaagtgtttatttcgacttaagatcattgtttttttttaaatctctgaggattattatagattttatggcgtttggagac

SEQ ID NO: 10293 - DNA, 2137 bp, Homo sapiens
  ENST00000554271
gatccgctgatctagtgcttctcgaaaaaaaccttcaggcggcccatgggtgagtggtcgccaagatcccgggaagcgtttctggtagtcccgactactttcctacacggctggcctcgggctcggctctttgtaggcggccttcggttggcggcgcaggctcgccccttgaccccgcccgccctcgggccgggctccgcactcctgcggggttggggtggtctgtccgcaacgggctactaggggaggcgcgctgtctgcggcgaaatgccaggtctttgttgtttggtccgaaatgtctcttcagtcccttagtttaatgtcgagggaacacttgcttgagggttgacttcggaattgaaaacgcgggtgatagtgcagaaaaaacagtaaagcagaagcaagttgctgcataatttgtctactgcttcaacctcaaacgtagatttatagcgcccgtcacaaagggcaggaccgctgcaaaaaaatggaatcttaaaactttagccatcgttcgctaaaggaaatgaaaggagaaattcaacagtcgcttggagcctgggttttgcttactgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacat

SEQ ID NO: 10294 - DNA, 856 bp, Homo sapiens
  ENST00000554795
tgcttctcgaaaaaaaccttcaggcggcccatggatttatagcgcccgtcacaaagggcaggaccgctgcaaaaaaatggaatcttaaaactttagccatcgttcgctaaaggaaatgaaaggagaaattcaacagtcgcttggagcctgggttttgcttacatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagag

SEQ ID NO: 10295 - DNA, 1191 bp, Homo sapiens
  ENST00000553941
aaaaaaaccttcaggcggcccatggatgttactatactggcatttgtttttaaaaagctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacaca

SEQ ID NO: 10296 - DNA, 2302 bp, Homo sapiens
  ENST00000602482
atgttactatactggcatttgtttttaaaaagctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgcccaaagaa

SEQ ID NO: 10297 - DNA, 1951 bp, Homo sapiens
  ENST00000554721
ctctgtctcaaaaaaaaaataaaataaggaaatataaaagaatatggaggcattaatatagtcattgttcatgttggcattttgatgtctatattattttttaaaacatttaataattttataataatttctaatttatgatttggtaccgtgtcttgtacagtaagttgaacatcatgaatccagaacatttatctgcagttattcttatataatgttaataactaggtttttcattgaatgttagtcaactattttagtaacttagtaaaaggaatcttctaagagcattgtacaaatatagcacatacaatatagatttctttttattttacttatgccctcttttttatttctaaaagctgcacatgtaaacttaaatatttaaactgaaatgggatgtcttatagaatgatttgggggggtgttaatgttgtaaaataatatctgtacacaaaatattggttttatatattataggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctac

SEQ ID NO: 10298 - DNA, 569 bp, Homo sapiens
  ENST00000553647
tattgtccataaagtttttattggaacacagccgtgcccattcatgtatgtattctctatggctgctttcccactacaactgcagagctgggtaatcgagacagagaaatgcagggctgaaactatttactatcttgccctttccagaaaaagcttgctggccactgcctcagaaccttaggttgtaagtctcacagaactggttgagaaaggatttgactctaaggaaaattactatttgaatttatttgatggtttattgagaaaatttgtttcatttccaacataataccaatgcttatctttcagattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaacct

SEQ ID NO: 10299 - DNA, 2524 bp, Homo sapiens
  ENST00000356057
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggatttatagcgcccgtcacaaagggcaggaccgctgcaaaaaaatggaatcttaaaactttagccatcgttcgctaaaggaaatgaaaggagaaattcaacagtcgcttggagcctgggttttgcttacatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgccc

SEQ ID NO: 10300 - DNA, 2338 bp, Homo sapiens
  ENST00000616435
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttataactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgccc

SEQ ID NO: 10301 - DNA, 9042 bp, Homo sapiens
  ENST00000396137
agtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaa

SEQ ID NO: 10302 - DNA, 409 bp, Homo sapiens
  ENST00000412001
gtacagtttgaaatcttgaagtgtgaagagttactattgacagcgcaactagaaagcatcaaaagacttatatcagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagc

SEQ ID NO: 10303 - DNA, 3648 bp, Homo sapiens
  ENST00000216039
acttcccgcgcccgctcgccgctgaccggagttgtctcctcctccgcagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaagga

SEQ ID NO: 10304 - DNA, 647 bp, Homo sapiens
  ENST00000545590
gaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcct

SEQ ID NO: 10305 - DNA, 467 bp, Homo sapiens
  ENST00000482442
atgaagctgtttggtgggacaagcgcaggtaatctgaatcaggcttgacttgatggagaacagcacggttgtggtataagcttttagtacttgggctcatggcatgagtggggaggtagccagttgtggtattacagccagggaaccttggaaaatgggctgcatcagagcctgccaccatttctcccctgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatca

SEQ ID NO: 10306 - DNA, 571 bp, Homo sapiens
  ENST00000427389
gaggacggcgcgggagggcgtttccggagcacgcgccgggcgggggccgctgacgtcgggctcagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccct

SEQ ID NO: 10307 - DNA, 529 bp, Homo sapiens
  ENST00000412832
agttggcggcgcgcactccaggtggcggccggctgcggtgaggggaccgccagcggcgagcagtcccggcggccctgggtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcag

SEQ ID NO: 10308 - DNA, 623 bp, Homo sapiens
  ENST00000417712
acttgaaatgtgactcccagcgagacacctacccttgacgctccctggacagtgcggcacggtcgggcccactaaccaaggcaatttgcgcccgaccgaatcaggtgcttcaaaatcccccctggtgagccgcgcgttaaccacacataaaacagtcaacgcagaaggagcgagaacgttcggccgaaaagcccggcacagagaagggaggggtgctgaaagccgcggactgcagccgctggcctggctgccgccccgaaacaacgcccacgcccgggagaagggcaggctggcgtccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggt

SEQ ID NO: 10309 - DNA, 843 bp, Homo sapiens
  ENST00000456626
gcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagag

SEQ ID NO: 10310 - DNA, 525 bp, Homo sapiens
  ENST00000462610
gtgaggacggcgcgggagggcgtttccggagcacgcgccgggcgggggccgctgacgtcgggctcagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggtt

SEQ ID NO: 10311 - DNA, 505 bp, Homo sapiens
  ENST00000490169
aaccacacataaaacagtcaacgcagaaggagcgagaacgttcggccgaaaagcccggcacagagaagggaggggtgctgaaagccgcggactgcagccgctggcctggctgccgccccgaaacaacgcccacgcccgggagaagggcaggctggcgtccagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaac

SEQ ID NO: 10312 - DNA, 480 bp, Homo sapiens
  ENST00000493939
ccagttggcggcgcgcactccaggtggcggccggctgcggtgaggggaccgccagcggcgagcagtcccggcggccctggggtctgcggccgggggcgcggcgggagggcgtctgggcctgcgctcacgtgacgggcggggagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtgg

SEQ ID NO: 10313 - DNA, 4378 bp, Homo sapiens
  ENST00000342232
gtccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagtgaagtcctgacaactagtggtgtgttagcccacagttctctgcagtggtgccgtcagccctttaaatggcccaccccaggcagactcagacacagggaaggaggcttggaattaggatgggatcgcgagagagatgaaacttggaaaattcagccagaggacctgttcggttcccctgggagtgctttgtggctttggggtcctctgggagctgaagcacacggccatgttggagagcaaaacttaataataattcttttttaaaatctgctgaagcagccccatccggcgaagttcttggcattggctactccatctgtcctagcagagtgtgactaaactggaaatgtatggagctgcattttttttttttttttgatggaagtcaacagctgccttactattttaccatctgacgtttttagtagggagctggggaaacgactgcccgaggaatgcggtcggaggattgtgttgctgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttttttttttttacaccatattagctaccttttcaatggagaagagacagttcacacaattccctggttagcacagatgtggactgagtgctttgtcacctgcagggtagtaacccagtgatgtttcttacagaagcacaatatgttgaaaatcctgggtgtgaccaatatggaataaagaagaaggcagaaagagagcaaatgaaaaatttcaacttgtatattcattttttacattttgctttgacttttaaatttaggaagtccgtttttacctgagaacaaatgtttaaagttcctgcgtcactctcagtactctcactgcccctcccaaaccctatagctccttacgctgggaaagctggttttttaaaaaaataataataaaatatttaatcttattaagtgttcatttaaaatgcgtaatgctttggaaataatgggtaacagatagcgagaggatatgtttataaagtgagcatgttggtcccatttataaatatatgtatgatttataagcttttttaaaacaaagctcaaattgttggtatttttctaaaatgtgcacagctgtattttacatgaaggctctttctaatgggttgttatactgtactcaacattttggacagcacatgaagtctgccaatgtacttaataaaacatgactttgtttatttaaagtttcttgctgtgaaaaagaactccctacctgtgagttcctttatttataattcttgaaaccaaaatgtataatgtacagttttcacaactgtatctgctctaataaaaaaaagttggttattaatgaa

SEQ ID NO: 10314 - DNA, 560 bp, Homo sapiens
  ENST00000518195
agtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagcccacagttctctgcagtggtgccgtcagccctttaaatggcccaccccaggcagactcagacacagggaaggaggcttggaattaggatgggatcgcgagagagatgaaacttggaaaattcagccagaggacctgttcggttcccctgggagtgctttgtggctttggggtcctctgggagctgaagcacacggccatgttg

SEQ ID NO: 10315 - DNA, 1651 bp, Homo sapiens
  ENST00000519947
tccgtgcccctgcggggagcgcgccggggctgccccccgaatgacgggcggaaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactt

SEQ ID NO: 10316 - DNA, 2191 bp, Homo sapiens
  ENST00000537256
ggaattcgggtgactttgctccaagatacacgcgtgtgtcccgactctcactcaatttataggggagagggactcgccaaatccctgttttctgggggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattggggtcgctccatcacccaaacaaaagaacaaggtttgccaggatgtccgagtgccccctggccctggctctcgtgtgcatggacgtgcc

SEQ ID NO: 10317 - DNA, 1030 bp, Homo sapiens
  ENST00000301008
ggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgt

SEQ ID NO: 10318 - DNA, 3985 bp, Homo sapiens
  ENST00000284262
agcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaa

SEQ ID NO: 10319 - DNA, 4023 bp, Homo sapiens
  ENST00000563609
tttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttgtccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtctgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagc

SEQ ID NO: 10320 - DNA, 3540 bp, Homo sapiens
  ENST00000371222
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataa

SEQ ID NO: 10321 - DNA, 1820 bp, Homo sapiens
  ENST00000302754
gagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 10322 - DNA, 1863 bp, Homo sapiens
  ENST00000252818
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgcca

SEQ ID NO: 10323 - DNA, 500 bp, Homo sapiens
  ENST00000600972
gcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccagagagaagaacagagtgttcgattctg

SEQ ID NO: 10324 - DNA, 5581 bp, Homo sapiens
  ENST00000382303
gcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtgaggagagaatacagcagttccaaggacaagggattcgtaccactgctcctcactcagtaaatagcagagacagaatttgaacggtctcactctgtcacctgagctagagtgcagtggtgcgatcacagcttactgcagcattgaactcctgggctcaagtgatcctcttgcctcagcctcccaagtaactgtgactgcagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 10325 - DNA, 514 bp, Homo sapiens
  ENST00000467541
agacttcggagggaagcaacccatcccctgccacaagaaagcaccgccactccagtgggaacggacacgcgtgcacacagccacgaatggtgatgacactcccaagtccatgtgggactccctccttatgcgggcctcagtctgtcatcttccttggagcaggaccaaagtaaataagataaagtcacaatttctcatccttcttcactcaacttttctttgaggagagaatacagcagttccaaggacaagggattcgtaccactgctcctcactcagtaaatagcagagacagaatttgaacgctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctcaa

SEQ ID NO: 10326 - DNA, 342 bp, Homo sapiens
  ENST00000475690
agtccatgtgggactccctccttatgcgggcctcagtctgtcatcttccttggagcaggaccaaagtaaataagataaagtcacaatttctcatccttcttcactcaacttttctttgaggagagaatacagcagttccaaggacaagggattcgtaccactgctcctcactcagtaaatagcagagacagaatttgaaccactttaccgtctttcctgcccagctgttgaaatatcaaactgtaccaagattttggccatgatggactctgttctctgcacactaagagatttatcttcctgatcatcagtagaaatattaataaataatattggttgcca

SEQ ID NO: 10327 - DNA, 7193 bp, Homo sapiens
  ENST00000489369
gggtccgcggcggagcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 10328 - DNA, 6912 bp, Homo sapiens
  ENST00000354485
ggtccgcggcggagcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaa

SEQ ID NO: 10329 - DNA, 5051 bp, Homo sapiens
  ENST00000382297
gcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 10330 - DNA, 5249 bp, Homo sapiens
  ENST00000382293
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 10331 - DNA, 1926 bp, Homo sapiens
  ENST00000382289
gagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgggccaggtgcagtggctgacacctatgatcccaacacttcgggaggccgatgcaggtggatcacatgagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctc

SEQ ID NO: 10332 - DNA, 2266 bp, Homo sapiens
  ENST00000382286
gtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 10333 - DNA, 5688 bp, Homo sapiens
  ENST00000619269
gagctccgggtccgcggcggagcgagcgagcggccggcaggttgggaggagcggccgaagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 10334 - DNA, 5162 bp, Homo sapiens
  ENST00000586659
gcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatga

SEQ ID NO: 10335 - DNA, 2952 bp, Homo sapiens
  ENST00000588787
ggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgctttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttga

SEQ ID NO: 10336 - DNA, 672 bp, Homo sapiens
  ENST00000587317
attactcccctggtgacgggagggttgtttgagattcaggaggagatcagcaagttgagggtacatttcaccatcagagcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtata

SEQ ID NO: 10337 - DNA, 3048 bp, Homo sapiens
  ENST00000589359
gcggcgcgcgcgaagacgctcgggcggcgggacccagggaaggcagcggccggagcgcgcaaggggtgagcctccaggcaaatggaaaacggaatttcctgcaattggtgaccatgtgttccaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccgcacctccgctgtcctcccctccaggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtag

SEQ ID NO: 10338 - DNA, 2703 bp, Homo sapiens
  ENST00000589894
atggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcggtgagtctcaatccggccgggtaggcacgggatgggtgggtctctgaaaggacagagatttgttgtttttgtttttgaggcagagtctcactctgtcgcccagggtggagtgcggtggcacgatctgggctcattgcaacctccgcctcccggcttcaagccattctgctgcctcagcctcctgagtagctgggataacag

SEQ ID NO: 10339 - DNA, 1812 bp, Homo sapiens
  ENST00000590400
agtgggaggaccctgcctcggggacttagggaggaaggaaggacgaggccggacaccccggcgcgcacacacacctgctgtccaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggtaagcggtcgcaggcaggcaggggagaatggcttggggggggggggcctctttcttcccatggctcatcctggactctcagaacgccagggtccaggcagggtgcggtggcgcatgcctgtaatcccagcactttgggaggccgaggcgggcagatcacttgaggtcaggagttggagaccagcctggccaacatggtgaaacccatctctactaaaaatacaaaaattagccaggtgtggtggcgtgcgcctgtaaacctcagctacccaggaggctgaggcaggagaatcgcttgaactagggaagcggaggttgcagtgagctgagattacaccactgcactccagcctgggcaacagagggagactctgtctcaaaaaaaaaaaaaaaaaaaaa

SEQ ID NO: 10340 - DNA, 624 bp, Homo sapiens
  ENST00000592675
gagacacagagagacttggagagagacaaagcaagacaggacgggagaacaaggacaagctcaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtcca

SEQ ID NO: 10341 - DNA, 923 bp, Homo sapiens
  ENST00000590685
agagaaaattgtttccataaaggggaaaggcttcactcctagctgcctccccaactttccctaccccttccccccgacccagtccaggcctgacccagctctcagctttggggtcactgggggtccccttcgccatgctttgcctctctttgtccccctgcgtctctgtctcctcagatccttgcaggaagacgaggttcccttcttccccaaccccttagcgcctcaacccccatccttccgtgtggccagctccgggcctgggctgaggggagggggtgcaggaagggtggggcctgttgggcttggggccccccagccccagggctatgtggaggctgggctatgggaacagctggagcctgtccagggcctggacagatgtgcaagcaggcagtgaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccct

SEQ ID NO: 10342 - DNA, 542 bp, Homo sapiens
  ENST00000588724
tgcggcgcgcgcgaagacgctcgggcggcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctgga

SEQ ID NO: 10343 - DNA, 576 bp, Homo sapiens
  ENST00000592903
gctcgggcggcgggacccagggaaggcagcggccggagcgcgcaagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggccca

SEQ ID NO: 10344 - DNA, 417 bp, Homo sapiens
  ENST00000592215
agaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgca

SEQ ID NO: 10345 - DNA, 437 bp, Homo sapiens
  ENST00000590095
aattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgggtgagcctccaggcaaatggaaaacggaatttcctgcaattggtgaccatgtgttccaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctca

SEQ ID NO: 10346 - DNA, 1126 bp, Homo sapiens
  ENST00000589427
cccgctctcccctgtctctgtcccactttctgcctctgttcctccccggctctgccctctccccgcactgtcccccctcgccctcctccgcggccatgccccagacggcgggaaggcggccgggcgtccggccgggctgggcctgggcttggcggctgggccggcgtggggagcggcagctgtttgccattagcccgggatcccacaggccccgccccctctctgcacggggcggggtccttctcgcctccccccaccccgagtttggggcgggaagacccccccccaccaccaccaccgacctccgcgatgtgcaggccggtcttgggtggtgggttggggagacccgcgccccttccctgcgctccctacctgtcccctcttataggctccagtctctccatctctgtcttatcctgtcaccccttccccattccccaggggtcccatggcgagagaagggtctcagccacagacatccatctcccccaccacaccccctcgtctcctttctcttccccttactcgggacgtgctggtcctcatcgagggcggtgagatgactgagtaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaa

SEQ ID NO: 10347 - DNA, 2080 bp, Homo sapiens
  ENST00000317477
ggcaagctggagggagctgcagggacagaggccaaagctgtctttccttgtgtaagggaggaactcttgctggccggggaacctcttggaattggtcttttttggggtttcagaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 10348 - DNA, 4665 bp, Homo sapiens
  ENST00000371153
tcgggcgctgttggcagctggcgacgcggggcgaagccgcggctggcggcgcctggccagtcccgcatccgccgcggtgggtgtgcccgcaggggtgcgccggggccagggccgagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgccaaagaccagtcctctcagggggatgaagagaaagaccctccgaagagccacccttattctgtggagaccccatatggctttcatttagacctggacttcctcaagtatgtggatgacatcgagaagggaaacactatcaaaagaattcctatccacagaagggccaagcaggccaaatttagcactctgccccgaaacttcagccttcctgacagtggggctcgcccccctgcagccccgcccctccaaaactggtctcccgtggtgccaagggaggcatcacttgggacacaggagcaaaaccagtcaccaccgcttggtaatgccccccaggcctcaacaagcaggagtgaggtgagctaccacaggaaggctctgttggcagaggccaccagacagttggaagctgctgagccagaggatgccgagctcacttttgggagtggacggccccagctcttgagagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggtgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 10349 - DNA, 3023 bp, Homo sapiens
  ENST00000371150
aaaaaagattttagtacttccaggaacccagtggaataaaaactgatgtgtgtgacagtggaggctcgggacctctactcttgcctttgctctaaggttgggtctgactatgggcccactgcctacagctgtatggatagcacagggcacaaagatgccagccagggagggcaaatgagagttgaaagccagcccacactccatttgccaagccttgcgctgcagcaccacatccacccagagggggctgttctcatttgcattgtgcaaaggcagtgtctggggccaagaatggccctgctgcgtggactccagacctcttcctgggcttttgcattcctgtgttcctctctggttcttgcatagtagaggttttctctggcctggttttggaggagcattatattgatatctggtatagttcactgaatattttctctgcgtgcatgtgtgtgtgtacgtgcatgtgtgtgtgtacaggggcaggagattaagtgctgctcacatatggaaatgggcccttcggctgagcagcacttcctgttgtaacagatcaaaccctcttcactgtcgggtaaagtggaaccacgttttgctttgcagggcagcatgcgagtctgcttcctgccacaaatcacaatttgactgctttctcattgtttcagtgctagttctagccttccccgttgggagccgcctcctgtcctgttgagcacattgcaagatctgtgtccttgctcgtgtatctactgtgagcacggtgtcatcaccacccccacaaccctagtgtcagtatgcacttgtgagccaggaaggaccactgaggtgcccttgagcagaagtgggtgctagaccatgagtccagaggcctacgttctgctcctacactcccattcactgagcaagtctgggcctcagatttcccagctgtaagacagggacaacaatggcacctacgccacatggttcttcatccacacttagaggggcattgttaacagagacagttctcccaacattgagcagaaagcaaggctcctccaagaggtccccaaaacattgatttacatgatctggttccctgtccctccttacctctccacacacctgcaacccttgtcccctcaaagcaatatcctggttttgctacattcccatgcatccccaagatcattctaacctgtgatgttgtgtctgcctagagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 10350 - DNA, 2103 bp, Homo sapiens
  ENST00000354381
gagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 10351 - DNA, 7997 bp, Homo sapiens
  ENST00000382545
cttgcagcgcccagaaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcccgcaggcgagggggattccaaactgagtgaaaggcagggtggaggggaaggcagcgagaggcaaagtcgcagatctcccgacctgctcgtgttgaagcacctccccctgggcgtgagggagacgcgcgctccggtgggggggccgcttgggtcccccccacccctggtccctggctgcttcccaccccgggctctctcctggcctcccacccccgcgcccggcttccaccatgacggtgatgtctggggagaacgtggacgaggcttcggccgccccgggccacccccaggatggcagctacccccggcaggccgaccacgacgaccacgagtgctgcgagcgcgtggtgatcaacatctccgggctgcgcttcgagacgcagctcaagaccctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcacgctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtctgagtacatggagatcgaagaggatatgaataatagcatagcccattatagacaggtcaatatcagaactgccaattgcaccactgctaaccaaaactgcgttaataagagcaagctactgaccgatgtttaaaaaacaaaggcaagcaaacaaaaaagccccacttagcagctcaaaagacttaaaaaacaaaacagaaaacctagtgactcatgtcacgctttgtagatactttactaagtagacttggaatgctctatttaactgtcaatgcgttgttgcattgaggattttgggggtggtgaaccagaagctttcaagatccatgacaaaataaactattttccttttattaaaaaatgggaaaagagagagtattttctaaaactggcttaaaaagattcagtccacgaactagtctaggtaaaataataatcatatgcttccccaaactgaaacatttttaatgctttggtttctttaacttttttaaaaactcagaacaagatgatcacttagaaatatgaaattgaaattcgcatgggactccagtaaaacatctttgcaaactgcgtagcacattgaagacagtgcatcagatgtattatatgtaacatgatagaccagccaaaatggacaatgaatagatatttttatttcgatcaactgaactgcatattacaaggtgaaaaaagaaaactccgattacttaagactggttcacaaagcaccttataaattggatactggtcctgatctgtagggatttccccctgggcccattctctttctaatccagattattctctaagaaaaagttaactgaattaaattaattgattcttctgcagtgccgctaaatggtctcaactgcagatgagccaaatacaggtcttttctcaccaggcctgcactccgacccctggctttcagaactggatgtaaaaccttagcctccttattgcaagagagcacaaatgaagttaaatgtaagcatgtttgaatctgatacaatttattttataatcgcatgctgagaagttaacccagacaataggggataagcttaagttgaaatcgattcttctaaaaatagatcctttttcatttgcattcaccaaaagtgcactcctccatttattaactattttattagtaaataaagtactgtatttaagtgcatatgttagtcagatgggaacaataactttttggagctcaaagcatgttctcttattcagcattatggcctatttgactaagatgtaccttgaattaattaatgcatgatttcagtaataaaaattttaaaagtaataaaaattacaagtctgtggggtgaaaggcccaatagaaattatggggggtgggggtgggggcactcagtcaattttcctgcctttgctcagggaaataccaggtttttgtgcaggtataggcggagagaggaccaatatgcccatcccttaaagggaagccatgtgaaaaactcaataagtcatcaaagtacatatagcaacacctaagaacaagtattctttctagctgaagacaaacacaagcaacacaaacaagcaaacaaacaaacaaacaaaaaggtgcaatactgcatgttttttggtgcattcttaggatgtaaatgaaaatgtttctctattatatgcatccgaagcagagctgatttttttttctttgcagtcattctttgaagtctgtagagacttcagccctccccttgaggctccctgaagaaactaaaccaattgatttaatagttgcttagtgcctttatcctgtacccacagtgaactgtagaaagtgcctccttaacacagctgagaagttaggtagcaaaagtggggaagggttggggcacagaccttttgctttttctttttccattctcgctctctcatttcaccactgtgagaagaccacaccaccctaaaccctggagaggagagacccaggagggtgctgtctctctggccatctactagcattggtccctttgacagcctgacgctggatgtgaactgagacccatctttgaactggacatgaactgtgaacttgttttttcctctctccaccaaagccaagataaactttttgggaatttgtttcctatcgagggccactttggacacacaaggcttcctcaggtccagtgtagtgctcctggcacctttccttatttttttctctgtcggtaacagcactttgcaaatctctctgacggtccagtcttttcaggcattgttgtggatgtgggaacactcagttcataataacctttcctaggccttccctcctggtctacccctttcagatatttcctgatgcccctatgatcttcccacctggcagtcacttcacaggttgaacatctaacttctgctgcccccccgttacccagcccagagaatggtggggaccctgttcctggctgaaagagagccacggaacacaggcctctggagctcggcagctgcccaccggtggagaggtactcacagcctttcaaaggaccctgaggtggggaatcttcattctgcacttagcatgtggctgcctgttacctgacattctggcccagcttcttctgaaaatctgtcctgcttctcccacccctttcccccatcctgtcctagaactagcagtgaggcaatcaccctagaaactcgagttacacccattctggctaactcgattaaaagaaagaacatggatatcttattttcctatgtgacttttgtgaatctgtgagatgaacacaacacacatcgtggaagatgaggggccaagaactgcgcagcatccgactacagggcattaaaccctcccatgtgatgtctccttctcgtctgaaccttaactcattctggcgattcctttcctacttgcttaaaaatccccaattaggaaaaaaatgccaacctcctcccaggcttggggttatcttgatctttcatttcaacgttgaggtctagtgcacacagaacttgaaacaccgcactctgtcaacagcaataatccactcagtactgtgggatggatgggttaatggatgagaaaacggcaccaagactgactttgggtatttggtatatttaccgtggttacactctggactggttgattcttctgcatgtgatatagaaaaaagtgctgcatgcggtgaacctgtcagtctgggactgggggtgagttgttgttatgagtttggggtggtgtgaggaaagtgaatgctgcttagctcatctgtagctcattgcaatgaattcagtaagaatggagtacagggattatctgtgtagcataggcatgcaatgtttgaccaagctcttaccctcgcactgtaatgtgttgaaatgtctttgtagacctgaaggtgcacttaacaaaactgcctattaagggatgactattttttggtttacttattcatatttattttagcagcctttttaccttttcttccccttcctaggcatggagctgtaacagctcatgtcctgactatgtgttttctccagaaggagaagacttctgatgtgctgatagctataattcctctcttccagtctattggggccctagttcaatagggtggcaatagaagagttggtcacaccagggctgttagccatcccagaatctctgaagtggttaactcacctgaagtgatctgaatcagagagaccaaagacattcatttcctctgtcctcagatttctagaagacaaattctagccaggaaaactttctgtttttgcatctcccttttcccatttgtgcccaactccccttgcactccctggagacttgagttctgattttcagttatatcagctcattgggagtgtgttcgtgggtgagccttgcagaatcagataaaccaatagcaagtccttctccaggattctggccagtgggcagtcatttccctgaaatgaattgtagggcaggtttagattccactatggtggacgtgaagcacaggtggtgtcacaatcttgatttgcttgagaattaaaaaaatacatgtaaatggtaaatgaggaatacatttttttaaagtagaaatttggtttagcctataaaaggccttcttcacattgtgtatagttacacgtttttcaaattaggtaccatctaaaagtcaataaaaatagtttcctagccctctcatttaatataggagacctcaaaacacatgctttttaacaattttacattttaattcttagtttggtagattggattgaaagaaaggagaaagaacattagcagaaggcactttcccattttcttccaggaatgacttattcctggggtggtgagaattggtgggtggtaaccatccatagtataaaattgttagaaagaatataaactgccaaacaagcatgttatcttcaggcttttccaagcaagaatgaagtcttttgatgtttatgttcattttaagaagacaaacaaactaaaattttaagaccagacacaacccaagttgaattgtgatctcaggaggtgaactctcattcaccatgtggcatattactacctgtatttatatcatggaatttcagggtatatgtgaacatgtctagtatgactcaggtaaacctttaaagaatgtatgttacttaccatttttgtaaagaagcaaacaggagctgaattgttaaccaaaactgttccattaccttgggtcactgtgcaaactaattcagggtacagatataaagtttagaagccttgggattaaatgccagcctctttgctcaggcaaaatgaccctgggctttcttgggaagtccagcatgtatgtaaggggtgaggccctgctgacctcagggcttttcgctttaaggagattaaccctagtcacagtgattttcatttaggagctaactaggagtttactctttatgacgtgaaacttcaaagagtatagaaaacttttgtaccacaatcaaagaagaagaaatggtgtatggaaagaaaacaaaacaaaacaagaaatctcttgtaaaatattccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcatcaattaaagatactttttaaggatcttatcaaggaa

SEQ ID NO: 10352 - DNA, 506 bp, Homo sapiens
  ENST00000543874
cggccgccgcggctcccgccagggcactgcaaagacgacctgccgcattcccactcgggctctccgctgactcagcaccgcccctgcgccaagccagccggccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgc

SEQ ID NO: 10353 - DNA, 2618 bp, Homo sapiens
  ENST00000639306
ctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcacgctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtctgagtacatggagatcgaagaggatatgaataatagcatagcccattatagacaggtcaatatcagaactgccaattgcaccactgctaaccaaaactgcgttaataagagcaagctactgaccgatgtttaaaaaacaaaggcaagcaaacaaaaaagccccacttagcagctcaaaagacttaaaaaacaaaacagaaaacctagtgactcatgtcacgctttgtagatactttactaagtagacttggaatgctctatttaactgtcaatgcgttgttgcattgaggattttgggggtggtgaaccagaagctttcaagatccatgacaaaataaactattttccttttattaaaaaatgggaaaagagagagtattttctaaaactggcttaaaaagattcagtccacgaactagtctaggtaaaataataatcatatgcttccccaaactgaaacatttttaatgctttggtttctttaacttttttaaaaactcagaacaagatgatcacttagaaatatgaaattgaaattcgcatgggactccagtaaaacatctttgcaaactgcgtagcacattgaagacagtgcatcagatgtattatatgtaacatgatagaccagccaaaatggacaatgaatagatatttttatttcgatcaactgaactgcatattacaaggtgaaaaaagaaaactccgattacttaagactggttcacaaagcaccttataaattggatactggtcctgatctgtagggatttccccctgggcccattctctttctaatccagattattctctaagaaaaagttaactgaattaaattaattgattcttctgcagtgccgctaaatggtctcaactgcagatgagccaaatacaggtcttttctcaccaggcctgcactccgacccctggctttcagaactggatgtaaaaccttagcctccttattgcaagagagcacaaatgaagttaaatgtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcat

SEQ ID NO: 10354 - DNA, 578 bp, Homo sapiens
  ENST00000639680
cgagatagctgagcaggaaggaaaccagaagggcgagcaggccacctccctggccatcctcagggtcatccgcttggcctgcactccgacccctggctttcagaactggatgtaaaaccttagcctccttattgcaagagagcacaaatgaagttaaatgtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatc

SEQ ID NO: 10355 - DNA, 4052 bp, Homo sapiens
  ENST00000640680
tgtgctccctgccgaggagatgtgagggattttctcttgggggagaaatcagtggtcgagcgcctgcccagctcaaatgccacccggctcagagggaggcctgcggcccagggatcccggagggagagcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcaggtggtcagaaaagatctccctgataaagtcactttgaacagaggtctgaaggatgtgaagaaggagccataaggatatctgaaagataggaggaaaataaaaaacaaaagactcaaaatactggcctgatgcagctctgatggaaaggaggacccctggccagagaggaagattcctaaggctcatcaaccaaccactgcagggagctttcagatttagaggagaagccccactccccctactaaacctctccaactggagctgacagtctttgccattggcctgtgaatgttcccttcctcctattggtcagcctggggccctgacccaccccacactccaaaattctgttaatttcatccagcattgttcaggtggctcctgtgcaccaggccgtgaggatacaaagatgactaagccttggccggcatcctggaggagctcacacggagagacctattaggactggcctgcactagcggtaggaatctggctggagctgaacgttcacactcttttggcagatggagatggagggttccaggccagaagggaacgcctgcagcgacagagctgagaagggagctcggattttatgtgaccacccccacctcctgggagaagccaaactacagaaacagagtcctggccttgccctgaggacaaagacccaaaatgtgcctgtacctaaagcaccctcccctttccaccataggactcaggggcgggagggagggagggggctgcctccaaccttgctcactgctccgttgttagaagagggatctacaaatgacggaggcaagggtttgccctgcatgactgctggactgtgtgggcatttttcattaccaggctccttcaagatgctgatgagaatacacccccataattacacccctccccatcttacagcttcctcagggatgggtctccccatccccatcctgtcactcttgacaggttgccatgtggtcagtgggtttctttgtgagggtcagagagggaggcctgggcctgctgagaggactgagctcccatctgccttcatcagactggaaactgagccattcagaacctcatccaatgtgtttttttccaacccagtttgattaaagtcagtatcacctgaaacccaagactaatgtatgtcgacaaggactcccaggtggccccctcggccaggacaactctccctccctgcagccctttggaaacaaactcaacaggcaggaggcgccattaccacggggccaggagccgggcccttgctgagtgagaccgagacgccactctggaaagtctcagggcatcaatatttcatgccgctggagctgtctttgtttttatgcaaattgctcaggctgccagatgggcaaaggctggcagcgtcatccatcaccaggctgttccctcgtcagcaacctcaccggctgccagggccctgcaggctggcctcagctgcggcccgtcctctcagtcggtctgcacagcgggacacagccccatcctagacactgtgggagacgcaggggaagccagagtccttgctccaggggactcacagatggacgactcataatgagataggaggcagctcgtcacttcagtgtgaatctgcatacctttcattttaacccacaaacctccacctgtgtggagggcatagcagggacatagcgagagtgggatgccataaatgactgaagtcaaggttgtaatggtccagcaacatttgcagaatcctgaaatggtgcacagaatcctgaaatggacaatcacctggaagcactgctgtagagggacttccgcattgagaggggactggagccaactactcccaacacctcctttccagaattccaagtctcagggttcctgtgcatgtccacctgttttctcctcaacaaaacaaaacaaaaaacttcccaagaacccaagagcatcctggtgggattctggaagattgggccaatccaagattctttgcagatgctggacatttaactctatcaaactggtaggagtcattccactcctacatatttgctcaaaggaaatgaaagcataaccccacacaaagactaaggcatgaatgttcacggcagctttccaaaaactgcaaccaacccaaaagtccagcagcaaatgaaaagataaacaacttgtgttatatccattcagtggaatactacacaacaataaaaaggaatgaactattgatacattcaacaacattaatgaatcataaaatatttcttctgaatgaaagatgaaaaaatggagtctggatgaggatacactgtttgaaactggcactgccccactacctccaacaccaccctgaccctcatcagccaccctcctatatgcaactttgagctggacactggggtgacgcaggtgggattgtaggggaatcctgtcctccaagaccaagcaggctgataggaaaagctctgcaaaacacagtcatgcatcctgaaaacttacaagagagctgaagagtgaaggctgatcccctggaagctggtgctccaaactgaggacaaaagtgagcatctacacaagcaggctagcagcacagggagacagagggctctctcagacactggccagggcaggctcctgggacaagaaagcgggactgattcacacctggaagataatcatcagggagcaccatctgcggtccaagaccccaaaggagaaaatggtgctccgaagacatgagatcaacacagagctggagtcccccacccacagccatccagctgccaagcagttcaggacaaggcccccaaatcatcatgcgaattactgtgaagctacatttctccagggctttaccatgtacagagccaggatttgaactcgggtggactgattctattctcagattccatcctgcctcccagccatcctactgctcaccgagccttgcagagcaggctggcacctggcatgcttggcagtgggtacatccttcctcattccacaactgaggaagcagcagctccgtgaaattaggccgtttgcaatggccacatactcctgagaggtagaatgggtactctaccagtgctgaccaaccagacttgagctcatcattcaacacatggcacctgaactgagaaaaggggtcatgggatggaaagagctctggacccctgacaattctgtggccctagcctacagctccccacaaggctcagctcctatatagggactccatggtctagtgggaaaggccctgggccagaaggccatggccaggtttaggtcaggactctgtagcactagttatgtgaccttaggaagtcactttgtccctgtgacttggtttccgcatctgcaaaacagagataacatctaacctcacgtgattattgtcatctagtgagataagtgaatgtggaatcactttgaaaagactacaacactacactgcaggatagccttgtcgcctgtaaaggaaacctctccaaggctgtgaccactacagattttgcctgaggttaagtcccttacttctctcccactcccacccccagcctgcctgggttcagtgttcttaaattgaaactgaagct

SEQ ID NO: 10356 - DNA, 1120 bp, Homo sapiens
  ENST00000640450
gaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggtggtcagaaaagatctccctgataaagtcactttgaacagaggtctgaaggatgtgaagaaggagccataaggatatctgaaaggatctctatatggcaagagctaccaccaaatctctcc

SEQ ID NO: 10357 - DNA, 426 bp, Homo sapiens
  ENST00000525120
cacccagctgagctctcctggaggttctggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcaggccataccgtaatcccagggtgggcactattgcttgtacacattttatcaatgagaaaaccagga

SEQ ID NO: 10358 - DNA, 1189 bp, Homo sapiens
  ENST00000639227
tcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggtggtcagaaaagatctccctgataaagtcactttgaacagaggtctgaaggatgtgaagaaggagccataaggatatctgaaagttcatgtcctcaggtactaggcatgtgggctttcagaacagtaagaagcatctactagaaacccaatagggtctcagaaaacaacactgcctaactaccaaggttattttgtgatgggccagaagaatcagtatgttctgatatcaggaaggcatgcagcagagcttctctcacagacctgtggacaacttagagaaatctcaaggaagggtggtgagggaggctgcaatagcacccagtgttgacgctgtcctgatcagcattcccactgacgatttggatgaggacacggacagcatgctgatcaaacctgagagggcatgacccagaacagatgtcacagtccatcttaagagattcttcaggcaaagactttggagctttagttggcttgtctccgtattaaccaatcgtgtgatattactccaacaagtcattacttggag

SEQ ID NO: 10359 - DNA, 11877 bp, Homo sapiens
  ENST00000633222
ggcgctgcgtggcgcggtgcggctgcgggcggcggccgggagctccgtacgcgccgcccgcgggactgcagagccggctcccggctggccgcccgcaccccgccgccgcccgctgccggggttctgccggcgctggccgtaacctaggaacatggaggccccggtgcccatccggaagggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtcttgaactaggggtttttttcccatcagaaggcaaaaatccctccatcaggggaaaaaaaatagactatttggaatggaactaaaacttctggccccccagcctacctatccctgttcttctaaacaggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacacacacacacacacacacacacatatatatatatatatattcattttctggagttcaggttcaggagcaaatccactgcttggtgggttggctgtctaagaggcctaatgggttaatttgtctcattggtaaccccactgggcctgggtttgctgccattgcctcagacactccggtatccatggattcctagacgttagaattgtctttctgccctccatgtgctgcagcttcagttcccatggctgaagcttgtcttactgagtgcacaagggccctgtggccctcacagttccagctgtcctgggccagacccaccccgggcctcctctctacagttcatcctgttcatcatctccattttcacctcttcccttgccacttggatcttattatcatttggctctgcatccgtcactttcacaaacctttcgctaaagagccagaatggatcccctgctttgaaaccaaggacaccaaggagtaggactccctgggaccaaattccactgatctggacctaaagggagcctcctctatgtggaaatgtctgaagtccgggactaagtgatggagtccctagatgatccaaaggcatcattttgatctccagacccaaactctctccccattaaactggcaaccagagctgctttttaaaaagaaccaaaggatgggtaaagaatcatttcccaccccccagaagaagtagagtgcaaatgagcactgcacagcctaaaggtagacagtaggttgaccctgaaatggcttcaggtagggggcttttaactcaccagactgggcgtctttgccttttgacggagtagcttaattttcccaaacagtgaattgcaggggtcgggctatgcaggggtggctccagcccaggcctcactgctgcctagttagcacctacagttgtcttggggcatggggcaccagctcagggtgctaggcccagggtgctcattagtgcctggtcacccacatccccaggtatctgcagggcatcccatgcccagcacaaagcctctgtgcttctcttcctctccttcatgggaggtggtgctgaatttccaaggcatggggtgggagggacacagatctttggaaaatagaaggtaaagcaacccatatctgaggcctaggtcagggatagatatcttatcacagtgtccttggcccaggactctaaaatgttcacatacagtcatgcacattcaccacaaaataggtacactgttgtcacacacaaacataaaacatgtaacgtgcaaaatacagacagaccaggttaacataaaagcaaacacagaagatatatggttataattgtatataaaatgcacactctgcacagatatagaatttacacagaacatacacaaaagacaaacatacaccacatacaaatatacaacctgaaactcagatgcaaaatacataaaaaactacatggacaaaatgcatatgcatataagatacacaaaggctactttaccattgtttctacacataaaatacacacaaactcagtatatacacacgatgcattaacttataataggcatacaagatacatagcacacatgcccaaaaatatcgcacaatacacatgaaatgcagacatatactcagacccattgccctgcccccagagctatgaattaacaggcacaaacaaaagatcagatgtaatcacctttgcctggcctgtgtctatatcccccaggatctttcaaggaatctctttctctattcttttctctcactaccagatttcactcctgagaagtaactcctaggtttcaagcaggaggatgggccaccacatcaagcagatatctgactaagaccaggaattgcatggggtctctaccaattcaccttcctcccaccagaaacctgggtgcagggtgtgaaagtacctgggacagctggtagcctaatataggcctccttgccatgacccttccttccttccagcaaatccgcacagacaacccaatagcccaggctccccttctcccagcacctgggatctccagattcagccctattctcttaaaagcagtaatggctcaagaaactgcaggatcttgagcccaggaccagggtaaagatgtccccaacattctctaagcccacagattttattgcccttccatcctttgcagctttgttgggggcacggtcaggaagttgagaccctatagagacctgtctcttaaaatgagccacctttacttgcttgtggcatttcacttgctcttgtgcataagcccaaaggggccaactcctgattcccctctgggtgtgttcaatcccgggcacgctcttccttttcctcttgttgggctcccctggatgccctgcctcccatccaattgctatgcaacccagttcagcttaagtaaaaagtgattaagaacatacatctaaggctaagcaagctaacactttttagagggcctgactttatcctatattctaaggccatatttaaatactttctaagattacccaccattttggattactcttggagctggttcttcccctaagtaggactagctgagagctgagtgcattttagcaaaggcttcacctacatcggaagtaaagagttgcagtcaggctttggatcaggcctcactcctgatttctgctcctgcagccatcccgttgtgtctcactctcccttccagtgatggtcgcagctcccagtctctacagaaaaggtaacaacagtagggagtggacatatgggtccaaaacgtgtgctttgctggaaacttgtgtttccaggtcaaggtaccattcctgttggcttcatcaagtgcctctgtggattcattttcaagaaacttggagttttcaggagaccgaaaaggaataggcccaggaaaggtggagagattgtcaggaagagagagtggctgagtgggtcaaatttcagagtaaactttttaggagccaacatttaattaagaaaataattaaggctctgtgctttctgaaacttcagtaatatttgacatgctctcttccttcttctctgcttgcctctgtccctctcacctgtgtttctgaggctagtgttggcatgtcaccatgaggttagccttttaaaaggggccccacgggagtgtgcctctagattgcgttagcctagtatggaaagggctcccatggaagctatgatggcctgagaccccagcctgggtgttcatgttgctgctccgtgttgggagggcccaggactagcttgttctacctattcttcctggatctctcactatattatagtgaggactctatcagtatcaacccatgtggagagaggacagcaccctctgaagctcctcaggctggggattcagcactgcccacagtagtagagtcacagaggctgactcccccctaaggaaactatagaacagtgtgcaaattgcatatgaaggtggcaccactacccctatgtcaggcaggggagcacagtgctttgacttgtttactcaagagaggggatgatggtgctgagctctgctccccagagctttcctggggcccattgtcataataacttgtatgtgggtgatggccgcctcatctgcgagggctataatatccatggtgctccttggttgcacaatggaggttcccctagccttggcaaggtatccattgccgggtttgaactcatgaccttaacctcattaacatcatcagtcacctgagccaacgcgcagagagggggatgctgggagctctctcagtagctattgtgaccatcatctatatcttcagacttagcccttgttgagtccaaccctgttcccctatcaaagcaaccagcagggacagatggaggtaggggctcccctacatgcaggaaggttctcttcctcaaactaacctagtttacttttcctttttttctgcttcccttcccaccaaatctcagcttcatctctcatagtttgtgtttgaatatttttaaagaggaaaagtgcaataaaataaatagtgactgttttctttagcaatagctctttcaaaatcttgctctcaggactgaaaagtgatagatagtacctggattatcagataatgcccttgacttctgggggctcattcacagtctctgtagtttcttcttcttcccacgtgttcacatgactcctgtcctcttgagatctgacctccttctggaatggacacatatgctaagatgcagtgtatgcacaaggaaggcctgtgagagggctttgtcactttgtctccttcctgtgtgcacctctctgtctccatgtgtgtctctgtcccctctccctctgtctccccatttctgcctgctgtcatacagcatccttacaacctctaggcatgaaaatcctaagtttgtgtgaccttttcagcccattttgttgactttccctcagtctggcagatgtaatggaagcctacacgaaagcacttcccaatagataagaataaagcatcctgagccattacagaagatcatttccatgcactaaaagccattacttgatccttttgcttccccttctcccttccccagggagacggatgctgagggaatgtggcctggaggtttgcacttgggatcagtagcctgggcagatttgggaattgccctctgactctctttcaaaataagctgacttgctcaaccaaagggactccgtgagagctgcagaaggaagcaggttcttgtgggtttcagtagaagtctacagggatagaagtttgggtggttagggcatgacattagtgaaataaagactctaccacccgctagagtgtgcagctgcacaaatatttgcacacatagccaggggcttcagaagagtcccctttcctaacatctgtgagcttaaatgttcagactggacaatcagggaaggctggcaaccccagggtcccattccatccttttttgatctaccttgctctatacacatatgtacagcaaaacctcagttaactgatggggaaacctcagggacaggaacatcctgattgctttgcaattttggttatttgagtgggaatgggaaagcatgtctggttcaacctttgttattgagaaaaatatttcctaagtaggttagcataactttcctgccttagttaagtagagtgtttgaagataacagggaccttgccttgctcagggtcaacattgtaaacctcaatgcttattgtacagtagtggacataggtagagaagaccaaagagacaggctgaatggctgctggctacaagacaggcctggaaatgggccactggggcacatcctggctcatcggagcccttgctgtcatttgcctctttctactgaaaggatagtaagaaaacataattcttgtcaatcgaggttttggttaattggtcctgagtttttagaggttttccatatatacatatatttatgtgtgtatatatatatatatagtatatgtatatatgtatactatttttaaattatagaattatacattgaccaatctccttagtttcacttatgtggaataaatttggcaatccaaggaataaactgcatttatgtgcattttttgaatgacctcctttgcattcttttcacctctccagttctactctttttttttctgcttagggacctctctagaaggcagatctttcataaaaaaagaacaggctacaggatcacctctttcctttccctcccaggtggctgcctgactcagggataaaagggaagtctgatctaacagccaggtgctttagcctttcttctgtctgccctggttggctataacctcatcactgaggatcagaaaagttattccaaactttgtactcgaggggagtggaaagcttgaagacctggcaaaggatttatctatttagcattctctttgtcattggtggtgccctaggtttgaggtttgtgagatctgaaagtaacattccaatgaagaactaaagcacatctctgccacacagaaggtgaggtttgtggcaatcaatggaactaacaaatccattctgttttttattatgactaaacctaagttgagggtgtgggtattagagcagctgaaattcagttgcctctttgggggtaagctgtacacatcactcaagaaacagctggatgcaagctaaaacctgctctcattctccctcttgcctgctagtgtgttagatccatggaagacagtttctctcagcctcacctcttgcatttgactgttgctttctacctagatgggagtgggagggatttttcactgtatctggagcaattgaagtggtgcaggggtgtctgccatctccccacacccacagaagccctccagtctggctatgttagttgtgatcaggcagcagaagcccataacccagacttgacatgaccagctggtgcactgaggcagttgaggtggcctgtctggatggctacttcttgtacttcatgaacctcagcatggaaatggatataactttctgtgctcctctgcactcctaaaatagtctaatatgttccagatgagtttgcagctgagaactccctgcatcattccactgatggatgcacagggcatgattatgtaataatgtggacagctactgcaacatctagatcattgagggcagtgtagatgtggctgtgtgctaggacccttggtagctatccagaggactcagtctggtgtctttctgagtctctgtgagaggcctctaagccctgcttctccttgaaaatgattccctagacaccgaatgccttgtttgtatgagtgaataaatgctctgggctgctagagaaagcaataggaggagctgggaggaagagaatattcaggggcgcactttgctaccaaacaatttccatgtcagctgctaacattactgcctttttagcctatgaagtgtagggcaaggactttgacctgccaggtggggctggaaaggagcacatcagctccaggctaagaaatgggatagaaaagcaagaagagaggcctggctggctttggcgggggtgagtctcagctcctgagggtttgaacatgctctgtgcttgccccagttctgccttcacgtgggatccagcgacccagtttccttttgttgtcgtgcttggatggttccttcatttgaagggccccaggaagctggaaagtcccatgatcaagctctagcctgctgagcaaacaataccccagccaaattggcctcttcctggttttctgcatccctgcacccctctctccactaaggataatcttggaacagttgcgattaatggtgccagcaatcaaggaagattctctagttttcatcagggacatagctgtaaagctcatgagtggaggatgctatttccttttccagacctgtgtgcttatgtgcttatataggctgcctctggagactttatattgtgtgtgatgtgtgtgtatatatatatacacacacatatatatatatatgtatatatatatatagagagagagagagagaggaaatggccgccactcacttaggctcatgcagcacagactccagttagggtttgcactggcttccttgctgcttgtgcatgaatcttcagctgccctcccatgtcctgtctctaataattgctgaaaactcaaagaggtagataaataagcctccttgggatcaatagcagaaggaactccaaggctgatggtaaagcttcgtaaggatgatgccgaaagggaactggggtctccatggtgataagaggctggggaccaatgagagctgaaggcggagcaggacttgcggggaagactcatgggagttgggagtcatttaactatttgtttgcttcttgaaaatttagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagaca

SEQ ID NO: 10360 - DNA, 1959 bp, Homo sapiens
  ENST00000369770
ggcacatagaagagtgagccatcatctggtttccagcgccaagacttctgcaggagagcctccgctgggctttcaagttggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagaca

SEQ ID NO: 10361 - DNA, 10836 bp, Homo sapiens
  ENST00000639048
tctgccggcgctggccgtaacctaggaacatggaggccccggtgcccatccggaagggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtcttgaactaggggtttttttcccatcagaaggcaaaaatccctccatcaggggaaaaaaaatagactatttggaatggaactaaaacttctggccccccagcctacctatccctgttcttctaaacaggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacacacacacacacacacacacacatatatatatatatatattcattttctggagttcaggttcaggagcaaatccactgcttggtgggttggctgtctaagaggcctaatgggttaatttgtctcattggtaaccccactgggcctgggtttgctgccattgcctcagacactccggtatccatggattcctagacgttagaattgtctttctgccctccatgtgctgcagcttcagttcccatggctgaagcttgtcttactgagtgcacaagggccctgtggccctcacagttccagctgtcctgggccagacccaccccgggcctcctctctacagttcatcctgttcatcatctccattttcacctcttcccttgccacttggatcttattatcatttggctctgcatccgtcactttcacaaacctttcgctaaagagccagaatggatcccctgctttgaaaccaaggacaccaaggagtaggactccctgggaccaaattccactgatctggacctaaagggagcctcctctatgtggaaatgtctgaagtccgggactaagtgatggagtccctagatgatccaaaggcatcattttgatctccagacccaaactctctccccattaaactggcaaccagagctgctttttaaaaagaaccaaaggatgggtaaagaatcatttcccaccccccagaagaagtagagtgcaaatgagcactgcacagcctaaaggtagacagtaggttgaccctgaaatggcttcaggtagggggcttttaactcaccagactgggcgtctttgccttttgacggagtagcttaattttcccaaacagtgaattgcaggggtcgggctatgcaggggtggctccagcccaggcctcactgctgcctagttagcacctacagttgtcttggggcatggggcaccagctcagggtgctaggcccagggtgctcattagtgcctggtcacccacatccccaggtatctgcagggcatcccatgcccagcacaaagcctctgtgcttctcttcctctccttcatgggaggtggtgctgaatttccaaggcatggggtgggagggacacagatctttggaaaatagaaggtaaagcaacccatatctgaggcctaggtcagggatagatatcttatcacagtgtccttggcccaggactctaaaatgttcacatacagtcatgcacattcaccacaaaataggtacactgttgtcacacacaaacataaaacatgtaacgtgcaaaatacagacagaccaggttaacataaaagcaaacacagaagatatatggttataattgtatataaaatgcacactctgcacagatatagaatttacacagaacatacacaaaagacaaacatacaccacatacaaatatacaacctgaaactcagatgcaaaatacataaaaaactacatggacaaaatgcatatgcatataagatacacaaaggctactttaccattgtttctacacataaaatacacacaaactcagtatatacacacgatgcattaacttataataggcatacaagatacatagcacacatgcccaaaaatatcgcacaatacacatgaaatgcagacatatactcagacccattgccctgcccccagagctatgaattaacaggcacaaacaaaagatcagatgtaatcacctttgcctggcctgtgtctatatcccccaggatctttcaaggaatctctttctctattcttttctctcactaccagatttcactcctgagaagtaactcctaggtttcaagcaggaggatgggccaccacatcaagcagatatctgactaagaccaggaattgcatggggtctctaccaattcaccttcctcccaccagaaacctgggtgcagggtgtgaaagtacctgggacagctggtagcctaatataggcctccttgccatgacccttccttccttccagcaaatccgcacagacaacccaatagcccaggctccccttctcccagcacctgggatctccagattcagccctattctcttaaaagcagtaatggctcaagaaactgcaggatcttgagcccaggaccagggtaaagatgtccccaacattctctaagcccacagattttattgcccttccatcctttgcagctttgttgggggcacggtcaggaagttgagaccctatagagacctgtctcttaaaatgagccacctttacttgcttgtggcatttcacttgctcttgtgcataagcccaaaggggccaactcctgattcccctctgggtgtgttcaatcccgggcacgctcttccttttcctcttgttgggctcccctggatgccctgcctcccatccaattgctatgcaacccagttcagcttaagtaaaaagtgattaagaacatacatctaaggctaagcaagctaacactttttagagggcctgactttatcctatattctaaggccatatttaaatactttctaagattacccaccattttggattactcttggagctggttcttcccctaagtaggactagctgagagctgagtgcattttagcaaaggcttcacctacatcggaagtaaagagttgcagtcaggctttggatcaggcctcactcctgatttctgctcctgcagccatcccgttgtgtctcactctcccttccagtgatggtcgcagctcccagtctctacagaaaaggtaacaacagtagggagtggacatatgggtccaaaacgtgtgctttgctggaaacttgtgtttccaggtcaaggtaccattcctgttggcttcatcaagtgcctctgtggattcattttcaagaaacttggagttttcaggagaccgaaaaggaataggcccaggaaaggtggagagattgtcaggaagagagagtggctgagtgggtcaaatttcagagtaaactttttaggagccaacatttaattaagaaaataattaaggctctgtgctttctgaaacttcagtaatatttgacatgctctcttccttcttctctgcttgcctctgtccctctcacctgtgtttctgaggctagtgttggcatgtcaccatgaggttagccttttaaaaggggccccacgggagtgtgcctctagattgcgttagcctagtatggaaagggctcccatggaagctatgatggcctgagaccccagcctgggtgttcatgttgctgctccgtgttgggagggcccaggactagcttgttctacctattcttcctggatctctcactatattatagtgaggactctatcagtatcaacccatgtggagagaggacagcaccctctgaagctcctcaggctggggattcagcactgcccacagtagtagagtcacagaggctgactcccccctaaggaaactatagaacagtgtgcaaattgcatatgaaggtggcaccactacccctatgtcaggcaggggagcacagtgctttgacttgtttactcaagagaggggatgatggtgctgagctctgctccccagagctttcctggggcccattgtcataataacttgtatgtgggtgatggccgcctcatctgcgagggctataatatccatggtgctccttggttgcacaatggaggttcccctagccttggcaaggtatccattgccgggtttgaactcatgaccttaacctcattaacatcatcagtcacctgagccaacgcgcagagagggggatgctgggagctctctcagtagctattgtgaccatcatctatatcttcagacttagcccttgttgagtccaaccctgttcccctatcaaagcaaccagcagggacagatggaggtaggggctcccctacatgcaggaaggttctcttcctcaaactaacctagtttacttttcctttttttctgcttcccttcccaccaaatctcagcttcatctctcatagtttgtgtttgaatatttttaaagaggaaaagtgcaataaaataaatagtgactgttttctttagcaatagctctttcaaaatcttgctctcaggactgaaaagtgatagatagtacctggattatcagataatgcccttgacttctgggggctcattcacagtctctgtagtttcttcttcttcccacgtgttcacatgactcctgtcctcttgagatctgacctccttctggaatggacacatatgctaagatgcagtgtatgcacaaggaaggcctgtgagagggctttgtcactttgtctccttcctgtgtgcacctctctgtctccatgtgtgtctctgtcccctctccctctgtctccccatttctgcctgctgtcatacagcatccttacaacctctaggcatgaaaatcctaagtttgtgtgaccttttcagcccattttgttgactttccctcagtctggcagatgtaatggaagcctacacgaaagcacttcccaatagataagaataaagcatcctgagccattacagaagatcatttccatgcactaaaagccattacttgatccttttgcttccccttctcccttccccagggagacggatgctgagggaatgtggcctggaggtttgcacttgggatcagtagcctgggcagatttgggaattgccctctgactctctttcaaaataagctgacttgctcaaccaaagggactccgtgagagctgcagaaggaagcaggttcttgtgggtttcagtagaagtctacagggatagaagtttgggtggttagggcatgacattagtgaaataaagactctaccacccgctagagtgtgcagctgcacaaatatttgcacacatagccaggggcttcagaagagtcccctttcctaacatctgtgagcttaaatgttcagactggacaatcagggaaggctggcaaccccagggtcccattccatccttttttgatctaccttgctctatacacatatgtacagcaaaacctcagttaactgatggggaaacctcagggacaggaacatcctgattgctttgcaattttggttatttgagtgggaatgggaaagcatgtctggttcaacctttgttattgagaaaaatatttcctaagtaggttagcataactttcctgccttagttaagtagagtgtttgaagataacagggaccttgccttgctcagggtcaacattgtaaacctcaatgcttattgtacagtagtggacataggtagagaagaccaaagagacaggctgaatggctgctggctacaagacaggcctggaaatgggccactggggcacatcctggctcatcggagcccttgctgtcatttgcctctttctactgaaaggatagtaagaaaacataattcttgtcaatcgaggttttggttaattggtcctgagtttttagaggttttccatatatacatatatttatgtgtgtatatatatatatatagtatatgtatatatgtatactatttttaaattatagaattatacattgaccaatctccttagtttcacttatgtggaataaatttggcaatccaaggaataaactgcatttatgtgcattttttgaatgacctcctttgcattcttttcacctctccagttctactctttttttttctgcttagggacctctctagaaggcagatctttcataaaaaaagaacaggctacaggatcacctctttcctttccctcccaggtggctgcctgactcagggataaaagggaagtctgatctaacagccaggtgctttagcctttcttctgtctgccctggttggctataacctcatcactgaggatcagaaaagttattccaaactttgtactcgaggggagtggaaagcttgaagacctggcaaaggatttatctatttagcattctctttgtcattggtggtgccctaggtttgaggtttgtgagatctgaaagtaacattccaatgaagaactaaagcacatctctgccacacagaaggtgaggtttgtggcaatcaatggaactaacaaatccattctgttttttattatgactaaacctaagttgagggtgtgggtattagagcagctgaaattcagttgcctctttgggggtaagctgtacacatcactcaagaaacagctggatgcaagctaaaacctgctctcattctccctcttgcctgctagtgtgttagatccatggaagacagtttctctcagcctcacctcttgcatttgactgttgctttctacctagatgggagtgggagggatttttcactgtatctggagcaattgaagtggtgcaggggtgtctgccatctccccacacccacagaagccctccagtctggctatgttagttgtgatcaggcagcagaagcccataacccagacttgacatgaccagctggtgcactgaggcagttgaggtggcctgtctggatggctacttcttgtacttcatgaacctcagcatggaaatggatataactttctgtgctcctctgcactcctaaaatagtctaatatgttccagatgagtttgcagctgagaactccctgcatcattccactgatggatgcacagggcatgattatgtaataatgtggacagctactgcaacatctagatcattgagggcagtgtagatgtggctgtgtgctaggacccttggtagctatccagaggactcagtctggtgtctttctgagtctctgtgagaggcctctaagccctgcttctccttgaaaatgattccctagacaccgaatgccttgtttgtatgagtgaataaatgctctgggctgctagagaaagcaataggaggagctgggaggaagagaatattcaggggcgcactttgctaccaaacaatttccatgtcagctgctaacattactgcctttttagcctatgaagtgtagggcaaggactttgacctgccaggtggggctggaaaggagcacatcagctccaggctaagaaatgggatagaaaagcaagaagagaggcctggctggctttggcgggggtgagtctcagctcctgagggtttgaacatgctctgtgcttgccccagttctgccttcacgtgggatccagcgacccagtttccttttgttgtcgtgcttggatggttccttcatttgaagggccccaggaagctggaaagtcccatgatcaagctctagcctgctgagcaaacaataccccagccaaattggcctcttcctggttttctgcatccctgcacccctctctccactaaggataatcttggaacagttgcgattaatggtgccagcaatcaaggaagattctctagttttcatcagggacatagctgtaaagctcatgagtggaggatgctatttccttttccagacctgtgtgcttatgtgcttatataggctgcctctggagactttatattgtgtgtgatgtgtgtgtatatatatatacacacacatatatatatatatgtatatatatatatagagagagagagagagaggaaatggccgccactcacttaggctcatgcagcacagactccagttagggtttgcactggcttccttgctgcttgtgcatgaatcttcagctgccctcccatgtcctgtctctaataattgctgaaaactcaaagaggtagataaataagcctccttgggatcaatagcagaaggaactccaaggctgatggtaaagcttcgtaaggatgatgccgaaagggaactggggtctccatggtgataagaggctggggaccaatgagagctgaaggcggagcaggacttgcggggaagactcatgggagttgggagtcatttaactatttgtttgcttcttgaaaatttagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaata

SEQ ID NO: 10362 - DNA, 6673 bp, Homo sapiens
  ENST00000640774
gagagcagctggggactagcaacctggatcaacccagggaggcccctggagaaggcaggcccagccaagcctgagtcttgctccctgggagaaaatgcttcaagctgatgggaagcctgcccagaagaggcaaggaggctgagggatagtcctcaggcctggcatcagaatagaggatgggcatgggggcctgttacctcccatgagggaagctgccagaccctcctaaatcttggcaccagctggttcaaatgccctggttccaccttgctgctgtttttttccaggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacacacacacacacacacacacacatatatatatatatatattcattttctggagttcaggttcaggagcaaatccactgcttggtgggttggctgtctaagaggcctaatgggttaatttgtctcattggtaaccccactgggcctgggtttgctgccattgcctcagacactccggtatccatggattcctagacgttagaattgtctttctgccctccatgtgctgcagcttcagttcccatggctgaagcttgtcttactgagtgcacaagggccctgtggccctcacagttccagctgtcctgggccagacccaccccgggcctcctctctacagttcatcctgttcatcatctccattttcacctcttcccttgccacttggatcttattatcatttggctctgcatccgtcactttcacaaacctttcgctaaagagccagaatggatcccctgctttgaaaccaaggacaccaaggagtaggactccctgggaccaaattccactgatctggacctaaagggagcctcctctatgtggaaatgtctgaagtccgggactaagtgatggagtccctagatgatccaaaggcatcattttgatctccagacccaaactctctccccattaaactggcaaccagagctgctttttaaaaagaaccaaaggatgggtaaagaatcatttcccaccccccagaagaagtagagtgcaaatgagcactgcacagcctaaaggtagacagtaggttgaccctgaaatggcttcaggtagggggcttttaactcaccagactgggcgtctttgccttttgacggagtagcttaattttcccaaacagtgaattgcaggggtcgggctatgcaggggtggctccagcccaggcctcactgctgcctagttagcacctacagttgtcttggggcatggggcaccagctcagggtgctaggcccagggtgctcattagtgcctggtcacccacatccccaggtatctgcagggcatcccatgcccagcacaaagcctctgtgcttctcttcctctccttcatgggaggtggtgctgaatttccaaggcatggggtgggagggacacagatctttggaaaatagaaggtaaagcaacccatatctgaggcctaggtcagggatagatatcttatcacagtgtccttggcccaggactctaaaatgttcacatacagtcatgcacattcaccacaaaataggtacactgttgtcacacacaaacataaaacatgtaacgtgcaaaatacagacagaccaggttaacataaaagcaaacacagaagatatatggttataattgtatataaaatgcacactctgcacagatatagaatttacacagaacatacacaaaagacaaacatacaccacatacaaatatacaacctgaaactcagatgcaaaatacataaaaaactacatggacaaaatgcatatgcatataagatacacaaaggctactttaccattgtttctacacataaaatacacacaaactcagtatatacacacgatgcattaacttataataggcatacaagatacatagcacacatgcccaaaaatatcgcacaatacacatgaaatgcagacatatactcagacccattgccctgcccccagagctatgaattaacaggcacaaacaaaagatcagatgtaatcacctttgcctggcctgtgtctatatcccccaggatctttcaaggaatctctttctctattcttttctctcactaccagatttcactcctgagaagtaactcctaggtttcaagcaggaggatgggccaccacatcaagcagatatctgactaagaccaggaattgcatggggtctctaccaattcaccttcctcccaccagaaacctgggtgcagggtgtgaaagtacctgggacagctggtagcctaatataggcctccttgccatgacccttccttccttccagcaaatccgcacagacaacccaatagcccaggctccccttctcccagcacctgggatctccagattcagccctattctcttaaaagcagtaatggctcaagaaactgcaggatcttgagcccaggaccagggtaaagatgtccccaacattctctaagcccacagattttattgcccttccatcctttgcagctttgttgggggcacggtcaggaagttgagaccctatagagacctgtctcttaaaatgagccacctttacttgcttgtggcatttcacttgctcttgtgcataagcccaaaggggccaactcctgattcccctctgggtgtgttcaatcccgggcacgctcttccttttcctcttgttgggctcccctggatgccctgcctcccatccaattgctatgcaacccagttcagcttaagtaaaaagtgattaagaacatacatctaaggctaagcaagctaacactttttagagggcctgactttatcctatattctaaggccatatttaaatactttctaagattacccaccattttggattactcttggagctggttcttcccctaagtaggactagctgagagctgagtgcattttagcaaaggcttcacctacatcggaagtaaagagttgcagtcaggctttggatcaggcctcactcctgatttctgctcctgcagccatcccgttgtgtctcactctcccttccagtgatggtcgcagctcccagtctctacagaaaaggtaacaacagtagggagtggacatatgggtccaaaacgtgtgctttgctggaaacttgtgtttccaggtcaaggtaccattcctgttggcttcatcaagtgcctctgtggattcattttcaagaaacttggagttttcaggagaccgaaaaggaataggcccaggaaaggtggagagattgtcaggaagagagagtggctgagtgggtcaaatttcagagtaaactttttaggagccaacatttaattaagaaaataattaaggctctgtgctttctgaaacttcagtaatatttgacatgctctcttccttcttctctgcttgcctctgtccctctcacctgtgtttctgaggctagtgttggcatgtcaccatgaggttagccttttaaaaggggccccacgggagtgtgcctctagattgcgttagcctagtatggaaagggctcccatggaagctatgatggcctgagaccccagcctgggtgttcatgttgctgctccgtgttgggagggcccaggactagcttgttctacctattcttcctggatctctcactatattatagtgaggactctatcagtatcaacccatgtggagagaggacagcaccctctgaagctcctcaggctggggattcagcactgcccacagtagtagagtcacagaggctgactcccccctaaggaaactatagaacagtgtgcaaattgcatatgaaggtggcaccactacccctatgtcaggcaggggagcacagtgctttgacttgtttactcaagagaggggatgatggtgctgagctctgctccccagagctttcctggggcccattgtcataataacttgtatgtgggtgatggccgcctcatctgcgagggctataatatccatggtgctccttggttgcacaatggaggttcccctagccttggcaaggtatccattgccgggtttgaactcatgaccttaacctcattaacatcatcagtcacctgagccaacgcgcagagagggggatgctgggagctctctcagtagctattgtgaccatcatctatatcttcagacttagcccttgttgagtccaaccctgttcccctatcaaagcaaccagcagggacagatggaggtaggggctcccctacatgcaggaaggttctcttcctcaaactaacctagtttacttttcctttttttctgcttcccttcccaccaaatctcagcttcatctctcatagtttgtgtttgaatatttttaaagaggaaaagtgcaataaaataaatagtgactgttttctttagcaatagctctttcaaaatcttgctctcaggactgaaaagtgatagatagtacctggattatcagataatgcccttgacttctgggggctcattcacagtctctgtagtttcttcttcttcccacgtgttcacatgactcctgtcctcttgagatctgacctccttctggaatggacacatatgctaagatgcagtgtatgcacaaggaaggcctgtgagagggctttgtcactttgtctccttcctgtgtgcacctctctgtctccatgtgtgtctctgtcccctctccctctgtctccccatttctgcctgctgtcatacagcatccttacaacctctaggcatgaaaatcctaagtttgtgtgaccttttcagcccattttgttgactttccctcagtctggcagatgtaatggaagcctacacgaaagcacttcccaatagataagaataaagcatcctgagccattacagaagatcatttccatgcactaaaagccattacttgatccttttgcttccccttctcccttccccagggagacggatgctgagggaatgtggcctggaggtttgcacttgggatcagtagcctgggcagatttgggaattgccctctgactctctttcaaaataagctgacttgctcaaccaaagggactccgtgagagctgcagaaggaagcaggttcttgtgggtttcagtagaagtctacagggatagaagtttgggtggttagggcatgacattagtgaaataaagactctaccacccgctagagtgtgcagctgcacaaatatttgcacacatagccaggggcttcagaagagtcccctttcctaacatctgtgagcttaaatgttcagactggacaatcagggaaggctggcaaccccagggtcccattccatccttttttgatctaccttgctctatacacatatgtacagcaaaacctcagttaactgatggggaaacctcagggacaggaacatcctgattgctttgcaattttggttatttgagtgggaatgggaaagcatgtctggttcaacctttgttattgagaaaaatatttcctaagtaggttagcataactttcctgccttagttaagtagagtgtttgaagataacagggaccttgccttgctcagggtcaacattgtaaacctcaatgcttattgtacagtagtggacataggtagagaagaccaaagagacaggctgaatggctgctggctacaagacaggcctggaaatgggccactggggcacatcctggctcatcggagcccttgctgtcatttgcctctttctactgaaaggatagtaagaaaacataattcttgtcaatcgaggttttggttaattggtcctgagtttttagaggttttccatatatacatatatttatgtgtgtatatatatatatatag

SEQ ID NO: 10363 - DNA, 5256 bp, Homo sapiens
  ENST00000639233
gggactgcagagccggctcccggctggccgcccgcaccccgccgccgcccgctgccggggttctgccggcgctggccgtaacctaggaacatggaggccccggtgcccatccggaagggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtcttgaactaggggtttttttcccatcagaaggcaaaaatccctccatcaggggaaaaaaaatagactatttggaatggaactaaaacttctggccccccagcctacctatccctgttcttctaaacaggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacacacacacacacacacacacacatatatatatatatatattcattttctggagttcaggttcaggagcaaatccactgcttggtgggttggctgtctaagaggcctaatgggttaatttgtctcattggtaaccccactgggcctgggtttgctgccattgcctcagacactccggtatccatggattcctagacgttagaattgtctttctgccctccatgtgctgcagcttcagttcccatggctgaagcttgtcttactgagtgcacaagggccctgtggccctcacagttccagctgtcctgggccagacccaccccgggcctcctctctacagttcatcctgttcatcatctccattttcacctcttcccttgccacttggatcttattatcatttggctctgcatccgtcactttcacaaacctttcgctaaagagccagaatggatcccctgctttgaaaccaaggacaccaaggagtaggactccctgggaccaaattccactgatctggacctaaagggagcctcctctatgtggaaatgtctgaagtccgggactaagtgatggagtccctagatgatccaaaggcatcattttgatctccagacccaaactctctccccattaaactggcaaccagagctgctttttaaaaagaaccaaaggatgggtaaagaatcatttcccaccccccagaagaagtagagtgcaaatgagcactgcacagcctaaaggtagacagtaggttgaccctgaaatggcttcaggtagggggcttttaactcaccagactgggcgtctttgccttttgacggagtagcttaattttcccaaacagtgaattgcaggggtcgggctatgcaggggtggctccagcccaggcctcactgctgcctagttagcacctacagttgtcttggggcatggggcaccagctcagggtgctaggcccagggtgctcattagtgcctggtcacccacatccccaggtatctgcagggcatcccatgcccagcacaaagcctctgtgcttctcttcctctccttcatgggaggtggtgctgaatttccaaggcatggggtgggagggacacagatctttggaaaatagaaggtaaagcaacccatatctgaggcctaggtcagggatagatatcttatcacagtgtccttggcccaggactctaaaatgttcacatacagtcatgcacattcaccacaaaataggtacactgttgtcacacacaaacataaaacatgtaacgtgcaaaatacagacagaccaggttaacataaaagcaaacacagaagatatatggttataattgtatataaaatgcacactctgcacagatatagaatttacacagaacatacacaaaagacaaacatacaccacatacaaatatacaacctgaaactcagatgcaaaatacataaaaaactacatggacaaaatgcatatgcatataagatacacaaaggctactttaccattgtttctacacataaaatacacacaaactcagtatatacacacgatgcattaacttataataggcatacaagatacatagcacacatgcccaaaaatatcgcacaatacacatgaaatgcagacatatactcagacccattgccctgcccccagagctatgaattaacaggcacaaacaaaagatcagatgtaatcacctttgcctggcctgtgtctatatcccccaggatctttcaaggaatctctttctctattcttttctctcactaccagatttcactcctgagaagtaactcctaggtttcaagcaggaggatgggccaccacatcaagcagatatctgactaagaccaggaattgcatggggtctctaccaattcaccttcctcccaccagaaacctgggtgcagggtgtgaaagtacctgggacagctggtagcctaatataggcctccttgccatgacccttccttccttccagcaaatccgcacagacaacccaatagcccaggctccccttctcccagcacctgggatctccagattcagccctattctcttaaaagcagtaatggctcaagaaactgcaggatcttgagcccaggaccagggtaaagatgtccccaacattctctaagcccacagattttattgcccttccatcctttgcagctttgttgggggcacggtcaggaagttgagaccctatagagacctgtctcttaaaatgagccacctttacttgcttgtggcatttcacttgctcttgtgcataagcccaaaggggccaactcctgattcccctctgggtgtgttcaatcccgggcacgctcttccttttcctcttgttgggctcccctggatgccctgcc

SEQ ID NO: 10364 - DNA, 1524 bp, Homo sapiens
  ENST00000638477
cggctttgctgcagagagggctttccccttcgctggggccgtgggctgccgccgagcccccgcgcttaaaaggaagctgagatctggggcggcagcctggcgcaggctactccccacccccagagatcaggttccgggattttgggttggacactgagcctcggcggtccctcggctggacgccgggggcttaagagctgaactgcgcttgggcccgcagcaggagccgaccgcgcgggcaggagggggttaaggtggcgctagcggccgcggccagcgggagggtctggtcctctgcgcggaggcgagcgctgagtgcgccgaacggaatcccggccggagcccggggcgatggggagagggcccagacccctccccgccctggggccggcgggattgggtcggcagggggccagtccggaagccggcttcctccaggctccccctctcgctgctgccaagccgcctcgcagctaggcaggcggagcgtttattctgtgctccctgccgaggagatgtgagggattttctcttgggggagaaatcagtggtcgagcgcctgcccagctcaaatgccacccggctcagagggaggcctgcggcccagggatcccggagggagagcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacac

SEQ ID NO: 10365 - DNA, 3279 bp, Homo sapiens
  ENST00000638616
agtccttcctgagagcagctggggactagcaacctggatcaacccagggaggcccctggagaaggcaggcccagccaagcctgagtcttgctccctgggagaaaatgcttcaagctgatgggaagcctgcccagaagaggcaaggaggctgagggatagtcctcaggcctggcatcagaatagaggatgggcatgggggcctgttacctcccatgagggaagctgccagaccctcctaaatcttggcaccagctggttcaaatgccctggttccaccttgctgctgtttttttccaggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtctt

SEQ ID NO: 10366 - DNA, 2827 bp, Homo sapiens
  ENST00000316361
tgagcctcggcggtccctcggctggacgccgggggcttaagagctgaactgcgcttgggcccgcagcaggagccgaccgcgcgggcaggagggggttaaggtggcgctagcggccgcggccagcgggagggtctggtcctctgcgcggaggcgagcgctgagtgcgccgaacggaatcccggccggagcccggggcgatggggagagggcccagacccctccccgccctggggccggcgggattgggtcggcagggggccagtccggaagccggcttcctccaggctccccctctcgctgctgccaagccgcctcgcagctaggcaggcggagcgtttattctgtgctccctgccgaggagatgtgagggattttctcttgggggagaaatcagtggtcgagcgcctgcccagctcaaatgccacccggctcagagggaggcctgcggcccagggatcccggagggagagcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccacca

SEQ ID NO: 10367 - DNA, 2426 bp, Homo sapiens
  ENST00000638532
gggagtcggggagtggagagggccagccctgcagtgctgcctgttcctgcggctcctctcggtgggggcgaacacagcagaagagtttctgccacactgcggaccgcacctgctgcatttccctgcgaagccaaatctttgctgggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacaca

SEQ ID NO: 10368 - DNA, 2496 bp, Homo sapiens
  ENST00000485317
ggggtctgcagatcctgtctggaggcaccacaataatagcaacacgtctctcccggggctggatcccgctgtgggcctggggtagctgctattgattatctcctccttgcctacttcattacgttggcaggagcctctcaccagtgcccctcaacttctgccctcccccatctccccggcccggcagcacccagctgagctctcctggaggttctggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacac

SEQ ID NO: 10369 - DNA, 1584 bp, Homo sapiens
  ENST00000640956
gcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacg

SEQ ID NO: 10370 - DNA, 2569 bp, Homo sapiens
  ENST00000369769
gcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctcttaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggttgcctaccctgtagatatgtggatgaagagtctaactagaataatgacttgtaaacccaccatgagttatttggtttttgacttaaattcctatttgaatcccctttcccggaattttaagtgtctctacaactttgaataaagggaaatgcccaaga

SEQ ID NO: 10371 - DNA, 4172 bp, Homo sapiens
  ENST00000328224
gttcgcggccaggggaggcgtgtgctgctcccgcagccagcgagagcgagagagggatggatgttggaggaggaattcgggcttaacaagtgatcgctgctgtctaggattttgtttcttttcgggggaaccttgacttcctttcccaggcaatccctcctgtgctgaactccagaggaaccaggagtcttggggtcttctctggggcagccccaacccccacccccaggctccagccgcgaggactctgtgcacccctcgggccaggcaacagaacttgttccgtggatatttggagcctccacctgccaaacccgagtgattccttttaccaccccccgccccccacccaggatcattcttcccctcctccagctgttgcagcttgagggggaaaaacaagccagccggtggattttctttatttttatttttcgccccgccggggaacggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggacttcttagtcttgagagtgccaggctatttatctcgaccagccaagctctggagagcaatgttgaatccctgagaagagagagcatggggcgtgctgatttaaaaacagaaaatgcaaagttggactgaaaatatccttagtcttccaagcaatctgcttaagggttccaaacttaccttaatttggtgagaaaagaagctgccctatttttctttcttcttcttctacaactggaaccagccatttccgaaaaccaccaccatggaggttgcaatggtgagtgcggagagctcagggtgcaacagtcacatgccttatggttatgctgcccaggcccgggcccgggagcgggagaggcttgctcactccagggcagctgcagcagctgctgttgcagcggccacagctgctgtcgaaggtagcgggggttctggtgggggctcccaccaccaccaccagtcacgcggggcctgtacctcccatgaccctcagagcagccggggtagtcggaggaggaggcgacagcggtctgagaagaagaaagcccactaccggcagagcagcttccctcattgctctgacctgatgcccagtggctctgaggagaagatcctgagggagctgagtgaggaggaggaagatgaggaggaggaggaagaggaggaagaggagggaaggttttactatagtgaagatgaccatggtgatgagtgttcctacacggatctgctgcctcaggatgagggcggtggcggctacagttcagtccgctacagtgactgttgtgaacgtgtggtgataaatgtgtcaggcctacgctttgagacccaaatgaaaactctggcccagtttccagagactttgttgggagaccctgaaaagaggactcagtactttgaccctttgcgcaatgagtatttttttgacaggaaccgccccagctttgatgccatcttgtattattatcaatcaggaggccgcctgaagaggccagtcaatgtcccctttgatatcttcactgaggaggtgaagttctatcagttgggggaggaggccctgttgaagtttcgggaggacgagggctttgtgagagaagaggaagacagggccctccccgagaatgaatttaaaaagcagatttggctcctctttgaatatccagagagctccagtcctgcaaggggcatagccattgtgtccgtcctggtcatcttaatctccattgtcatcttttgcctggaaaccttgcctgagtttagggacgacagggatctcgtcatggcactgagtgctggcgggcatggtgggttgttgaatgatacttcagcaccccatctggagaactcagggcacacaatattcaatgaccccttcttcatcgtggaaacagtctgtattgtatggttttcctttgagtttgtggttcgctgctttgcttgtcccagccaagcactcttcttcaaaaacatcatgaacatcattgacattgtctccattttgccttacttcatcacactgggcactgacctggcccagcaacaggggggtggcaatggtcagcagcagcaggccatgtcctttgccatcctcagaatcattcgtctggtccgagtattccggatcttcaaactctccaggcactccaaaggcctgcagatcctgggccacaccctcagagccagcatgcgggaactgggccttctgatcttcttcctcttcattggggtcatcctcttttctagtgctgtgtattttgcagaggcggatgaacctactacccatttccaaagcatcccagatgcattttggtgggctgtggtgaccatgacaactgtgggctatggggacatgaagcccatcactgtagggggcaagattgtcgggtccctgtgtgccattgcgggtgtcttaaccattgctttgccagtgccagtgattgtctctaactttaactatttctaccacagagagactgaaaatgaggaacagacacagctaacgcagaatgcagtcagttgtccatacctcccctctaatttgctcaagaaatttcggagctctacttcttcttccctgggggacaagtcagagtatctagagatggaagaaggagttaaggaatctctgtgtgcaaaggaggagaagtgtcagggaaagggggatgacagtgagacagataaaaacaactgttctaatgcaaaggctgtggagactgatgtgtgaatctttttccacctgccactgctcccccctcagcatctccaaatatatttatgcatagagagtgcagttatgaaaatgaaatatgcaaatgatccaatgcatacagtagtacactatttaatggttatacatggcataattgttactaaacttgtattacatatcaaataaatgatacatcttggagaagagggaggaataggagcaaatctatctttatatttttattagaatgcaagaattttgcacattaactggaaaagatgttaacagtaaagatggagagagagagtgtgtgcgtgtgtgtgtatatgtgtgtgtgtgtgaagtaaattgtcaatgttagtaattgtgcagtgaagggaaaagttggcattttgaagtatttactatgtaagaactaatgaatctgagcagtcatttatcagtgctttaacagcatatcgtatgtctttggattctgtagttgttttttaaaaattgtaagaaatactgtgtagagaaaaaagaaagtaaattatttaatagactataggtcacaattttatcttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgtgaatgtttactaatgtaacagttcaatgacaatcattggaagaatgatttctttagtcttattttattgttttcttttcattgtgtgagactaatgatcatgcagataacatcacaggattctctcctcttttaaaatctaaataactgattgacaaaggaattatgaagtaaaatttagcaactga

SEQ ID NO: 10372 - DNA, 545 bp, Homo sapiens
  ENST00000526518
attttcccaaacccggggatgcggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggact

SEQ ID NO: 10373 - DNA, 580 bp, Homo sapiens
  ENST00000478609
attccctttcaggatgctcctacagcagctgcctaatactctcagttgcagtcagatgttggctgggaccacagtcatctaaggatactgctcaagctggctgttgtctggaaactcagctggggctactgatcagagcacctgcatgtggctgtccagcaaggcaatgttaaggaatcttggaaaatcaggactcagagtttcttgcttgggtcttggaacatgggtgacatttggaggtcaaatttcagatgaggtaagttacctttggcctctattatgctaatgaaagaaaatgcagagagagctgtattgcaggagtcctcttcctgggaccctgacactctacagggataaggtttaattcacaggaaatggtaaaattgactcagagattattgttgattttatttttcctgttgtattttttacatttagactattaatagcccttgaagctgtacattatatatgcaggttgaacagtcagagaatgaaacaatttggaattaacattagtcactttatgaaaagattgtattgctgtgatgttgttttgctttatttgtttgtttacttt

SEQ ID NO: 10374 - DNA, 567 bp, Homo sapiens
  ENST00000477912
attccctttcaggatgctcctacagcagctgcctaatactctcagttgcagtcagatgttggctgggaccacagtcatctaaggatactgctcaagctggctgttgtctggaaactcagctggggctactgatcagagcacctgcatgtggctgtccagcaaggcaatgttaaggtcccatccagatctactgaatcataatctccagaagtgagatccagaacctgcattttcaggctgggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagc

SEQ ID NO: 10375 - DNA, 531 bp, Homo sapiens
  ENST00000472028
attccctttcaggatgctcctacagcagctgcctaatactctcagttgcagtcagatgttggctgggaccacagtcatctaaggatactgctcaagctggctgttgtctggaaactcagctggggctactgatcagagcacctgcatgtggctgtccagcaaggcaatgttaaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctc

SEQ ID NO: 10376 - DNA, 3122 bp, Homo sapiens
  ENST00000490337
agaaaaatcaattcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaa

SEQ ID NO: 10377 - DNA, 1806 bp, Homo sapiens
  ENST00000389636
agtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagtttt

SEQ ID NO: 10378 - DNA, 3301 bp, Homo sapiens
  ENST00000471742
atgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatctt

SEQ ID NO: 10379 - DNA, 552 bp, Homo sapiens
  ENST00000475456
acagatgctctttccatgccatgcagctgctgctgtggggtgggagaagggtggcatcggcaattcaccgctgtctttcctactctcttcactgcctttttcagcgatatgaagttaaaaccaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcga

SEQ ID NO: 10380 - DNA, 4086 bp, Homo sapiens
  ENST00000302490
agttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaa

SEQ ID NO: 10381 - DNA, 1119 bp, Homo sapiens
  ENST00000389634
atgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataa

SEQ ID NO: 10382 - DNA, 576 bp, Homo sapiens
  ENST00000489036
atagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgat

SEQ ID NO: 10383 - DNA, 555 bp, Homo sapiens
  ENST00000476362
agctttgcctgaggcctctgggcttcatgcaggaggaggagatcccagaacaaaatcaaccccattttgcaaaccaggaagctaaatttacagagaggtcagatgatttgcctacgtttatttttctagttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagcaaattcttgaaagaaaccaaacttcaactctgaatagtgctcatatttagattttggggtttgtttcctgcttctgctcccaggattgaagggctccctccagaggctgcagctcgagtatgtggatgtggtctttgcaaatcgaccggacagtaacactcccatggaagaaattgtccgagccatgacacatgtgataaaccaaggcatgg

SEQ ID NO: 10384 - DNA, 555 bp, Homo sapiens
  ENST00000461717
gtgttgattcaatggctgctctacaatggcgcctgagattttgctgagctgtgggtggcaggagttttacaacagtcacagctctgtctcagcctcaaggaaaaagtcacaagctttcaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgt

SEQ ID NO: 10385 - DNA, 1546 bp, Homo sapiens
  ENST00000497291
ctttgggcaggctaaatcccagccttcaagtaacccctcagtgccctatgtctgaaggaaagaatacttctgtcctatggatactggctgagacttctttctttccctctccactaaaactaagaaaaataaggagtggttagtgagaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgca

SEQ ID NO: 10386 - DNA, 460 bp, Homo sapiens
  ENST00000496923
cctatgaaagtggtgttaacctctttgatactgccgaagtctatgctgctggaaaggctgaagtgattctggggagcatcatcaagaagaaaggctggaggaagtaacttgacaagaagctgattatccccccacacacatgcatttatgtttgctgtttattttattaactctggatgcaaaggaatgatgaaacaagaagactttgggataaataccccaaagctttcttatctgaacacatttagtcagcatctctcctgtgtgcccaggaaccctattatctggctattcagaacaatgcttcatctgctatccttgagaaacatgaggggctgtgcttacacgtccctttccaacacctcctgtagccaaagatagtggtaataagggaagctataacatctatgggcagtggggaggtaatacttccccatttcactatagatttcagccccaa

SEQ ID NO: 10387 - DNA, 4437 bp, Homo sapiens
  ENST00000618897
aattcactggcgtgttccgcggcataagcaccccctctctgccttcccccagttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggcaactgttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttagttatgtccttaagaaaaaattccacgcactcttattattttcttttctcttccaaaaagaattccctggcagagaatctatcattccaaaaggtaacct

SEQ ID NO: 10388 - DNA, 822 bp, Homo sapiens
  ENST00000378111
agacgtccaccaaagccacacatcgcgacacacggaggcagaaagcagcggtctcctaagaagttagacacgaggaatctcgggcagcgagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgg

SEQ ID NO: 10389 - DNA, 4201 bp, Homo sapiens
  ENST00000378097
ggaccgaggactggccgaggggcgcgccccgtccgctgccacccgcgggaggagcctcggaaggcggcgcaccgcgccgcacactcagtccaagaacccgcctcgcgtcactgtcgccgtcagggccgcggagccaatcagagcccaagtcgagggctgcgctttgcgagcgccagccaatcggtgcggcggcgggcccatcctgatttgcatgtccgacgacccctcaaccaatggtaatgtgactggcgtgaacaatagccaatcagaagctggaagaggcgtggccccgggcgtcccacgaggtgaagatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtga

SEQ ID NO: 10390 - DNA, 560 bp, Homo sapiens
  ENST00000493807
gatgctgctggcggaacctgcaggagctagcgggattcgggggcgctaaagtcgcaggggcagggcgggaaggaagatccggcgcggggcacaggatccggagctggagcccccagaactctgtgagaggtgccccctccgccatcacctgagctccatcgaatgcctgaaatcctcacctctgcaggagtgagtctcccaagaggccctggaggcccaggcccagaccctgggggatatggaagcactcctttgtcgtggcgtgggaagccccacactgctctttccttggtgacgggtgacccgccatgttcaggcccctcctggtctatcttcgggaagccgaggcagcagcttggagccagagccggaggcagagcggctccatccgtggggagccgcgccacctctgcgcctcctccgcgcctcctctgcgccccgcgccgtgctgagtcaggctctgaaacgcagtcatcatccggaagtggttcttgctgtggccccatccccctgtgtgattttcctaccttggctcacttaaaatttcaatctggctctga

SEQ ID NO: 10391 - DNA, 1202 bp, Homo sapiens
  ENST00000378092
agcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaa

SEQ ID NO: 10392 - DNA, 413 bp, Homo sapiens
  ENST00000478098
gattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgaggtaagatggggctctcccagcaccccagaacccagcacgggctcgccagagcacatggttaagtctgccgcgtggac

SEQ ID NO: 10393 - DNA, 486 bp, Homo sapiens
  ENST00000445501
gggggcgctaaagtcgcaggggcagggcgggaaggaagatccggcgcggggcacaggatccggagctggagcccccagaggcctcacgacaggactagtgccttggtaagaagaggaaaaggccagagctccctccctaccctgtgtggacccagcaggaaggaattctgtctgcaagagagagccctcacctggaaccaaatcagccaggaccctgatgttggatttaccagcctccagcaccgtgagacagaaacgtctgctgtttcagccacccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcct

SEQ ID NO: 10394 - DNA, 959 bp, Homo sapiens
  ENST00000389632
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaa

SEQ ID NO: 10395 - DNA, 961 bp, Homo sapiens
  ENST00000428161
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagg

SEQ ID NO: 10396 - DNA, 2396 bp, Homo sapiens
  ENST00000602612
gctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgcaaaggcccaaaaaggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccatcggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggcgaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcatcttccattatccacgagattgatagtattttgggcaataaaccctacagcaaaaagga

SEQ ID NO: 10397 - DNA, 500 bp, Homo sapiens
  ENST00000435937
ggggcctgggtgtgcggctatggggactgaactgtcgagggctcctgctgcctctgcaggggacaggccctgccagctactgagtgagcagcctgcggcagccctgactcactgcgggtcgtgccgtctgtgcagcactggggtacccaccacccagtgccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggagg

SEQ ID NO: 10398 - DNA, 4273 bp, Homo sapiens
  ENST00000164247
gaaatgcaaagcaggggctgtggggaaatctcaccaacccctcctcccctgggaggtggcaaaggtggtggactgggctgctgggaccctggggaggaatgaaacagaggctgtgttgatggcctgcagttccttgtaatgtggtcatcaaacggtgtacagttcccgtctgtggctgcaggctggagagctgactgctggcacagatacagcctgacctcgggtcaacacttctcggagtccagaggggttgggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctccagtgctctctctcctctggccttcagcaggctgggtcacagagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 10399 - DNA, 856 bp, Homo sapiens
  ENST00000459822
agaaggagtggctggagggatgagaggggagcgtggagtcctgggagctggggaagccgcaggcagcacctctgtcaccccgatacgatgggcaccgctggacctagcaacgaagaggtcaccgcaaccttgaattttcccactgtaaaaaaccgagcaagtctggataagtgaggctggctccatgtatccagaatcaacgacgggctccccggctcggctctcgctgcggcagacgggctcccccgggatgatctacagccctgggtgtttctgtctgcaccataaacagcgctgaacatcagcgacagctgcggagggcgttcagtgagagctgagcctctggggacagagcatagaacccacgaaagacgcaggcacaggcagtaccccagcagcccatcagtcttgggaagccagacctttccggataatcactggggcctgagccagagcccgtgtctgtgacagccacagggaaaggcagtgtctgtcctaagaagagccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggcccgggggcatgggacattggtggttctttctgacctgcacctgctggggttga

SEQ ID NO: 10400 - DNA, 536 bp, Homo sapiens
  ENST00000472700
agacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggatcttcgcggcgtctcagcctctccggagctcactgttcccatctgtaagaggaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgt

SEQ ID NO: 10401 - DNA, 4142 bp, Homo sapiens
  ENST00000378083
acttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccgcatgcacggcctttccctggacggctgcaccgcccagcgcacaggcatgaagtatcggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaaggggacccatttagttcctccaagtcaaggacattcatcatagaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 10402 - DNA, 1336 bp, Homo sapiens
  ENST00000458166
agagtgtctggtgatccctaataaaccagactgtggcctttttaacgagcagacgcccccacgaaggcaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagacca

SEQ ID NO: 10403 - DNA, 683 bp, Homo sapiens
  ENST00000462676
tacgcagccggcaaggctgaagtggtactgggaaacatcattaagaagaaaggatggaggatcttcgcggcgtctcagcctctccggagctcactgttcccatctgtaagagggtgtgtgtgggaccgttccggcagggctatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctcaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgta

SEQ ID NO: 10404 - DNA, 916 bp, Homo sapiens
  ENST00000481789
gggagagagcactcccctagggccaggaggttcttctgggccacgggtggcagccgagaccccaggctgccaagtttcctaagagaaggaaggccagcacctcgcctccttgtcctgacttggggttgggccagcaccacagtctttgcacttcagagcctggacaggccccgctcatccaccagcccgtgcccggcccactgcccactctcccctacttgagaggcctggggcaggggcactgccctggcttcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaa

SEQ ID NO: 10405 - DNA, 4165 bp, Homo sapiens
  ENST00000352527
atcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtg

SEQ ID NO: 10406 - DNA, 4207 bp, Homo sapiens
  ENST00000341524
atcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtg

SEQ ID NO: 10407 - DNA, 2458 bp, Homo sapiens
  ENST00000303790
atgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggcttgcgaggatccctggaacgcctccagctgggatacgtggacattgtctttgccaatcgctcagaccccaactgtcctatggaggagattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctggcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaacctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagccata

SEQ ID NO: 10408 - DNA, 859 bp, Homo sapiens
  ENST00000572275
ttggcctccagggctaccagtggctcaaggacaaagtgcagagtgaagatggcaagaagcaacaagccaaagtcatggaccttcttcctgtcgctcaccagctgggctgcaccgtggcccagcttgctattggtgagacattgcaccctgcaggggccctgtctcctcctgacatgctcccaagcccatcctaaaactggtttgtccctagggaggacgcttgtcttcagagacacttctgaaatctatgtggtcactgttccccatcagtcctctttttttcctcctctggccccagcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggccctt

SEQ ID NO: 10409 - DNA, 2406 bp, Homo sapiens
  ENST00000570587
atgcaggtgtctatcgcgtgtaccgagcagaaccttcgcagccggagcagtgaggaccgtctgtgtggaccccggccgggccccgggggcggtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggctggagtgtaatggcacgatctcggctcactgcaacctcctcctcccgggttcaagggattctcctacctcagcgtctcgagtaactgggattacaggcacacgccaccacgcctggctaattttttgtatttttagtagaaatggggtttcaccacgttagccaggctggtctcaaactcctgacctcaggcttgcgaggatccctggaacgcctccagctgggatacgtggacattgtctttgccaatcgctcagaccccaactgtcctatggagggtaaaagcagcacccccaaaccttacagtccttcaaaactgagcacttccttgctgggtgcggtggctcattcctgtaatcccaggacgttgggaggccaaggcaggaggatcacttggggcctggagttcgagaacagtctgggcaacatagcaagaccctgtctctacaaaaaatgttttaaaattagctggctgtggtggtgtgtgccttgtactcccagctgttcaggaggctgaggcaggaggatcattcaagcccaggagtttgaggccacagtgagctatgattgcaccactgaactacatcctgagtgacagagtgagaccctgtctcaaaaaatctaaaatacaaaaattgagcacttcctcaaaccctcagcaggaagccagcccctgctcagaaggcctccaaaactccacagtggaggctgagactccaggatgtggacaggaagagaggcaaagaattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaa

SEQ ID NO: 10410 - DNA, 683 bp, Homo sapiens
  ENST00000576981
gagatcaagctatgtcatcactaccaagattttttggggaggacaggcagaaaccgagcgaggtttaagccgaaagcacatcattgaggagattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggtttgcagccctcatccctgcctttaccttagcctcatccatggctaggtccttttcctgacacccagtgttcttcccttaggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacag

SEQ ID NO: 10411 - DNA, 572 bp, Homo sapiens
  ENST00000574006
gtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaagtaaggactggggtgaaagagctaagctccatttggaaggctgagaggaccccagggattatcttctcgttttccctctaaagaaccctgggacttctgagaacgtgaagttccaaccttttggcggagggacccgaaagcactgtaggagctacagtcccaacattagtccctctctggcttagaagtcaatgggcgtactgtgcagctacattaa

SEQ ID NO: 10412 - DNA, 1315 bp, Homo sapiens
  ENST00000570852
cgcgctgaagtggcatctctctcccgccccgcttccccctgggtccttatcctccgagacctttacctcatcctcgacctttaccctcatccatttccccctcctaatccttgctcctgtgtcccccgtaactgaatatctccactcctggcgccccccacgtttcttccctcccgccgcaaacctcgcgacctccagcagcccgcccccgcgggcccgatcctgcctggcggctcccgccgcagcctcctcagccttcccgctctgccggggttcgccccactacgcccccggtcgtcagccctcgggcttccctgctcccccctcccgtcccctcggagccccctcccccgcctcggccagccagcatgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggtatgggggtggccgggcagcccaccccttccgctttcctttcgggacccctgagactgcttgagatggccgccaagaccccttcaaacttcactaagtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtacctgggtcacatttggttctcagatctcagatgagacagc

SEQ ID NO: 10413 - DNA, 7965 bp, Homo sapiens
  ENST00000379472
ggacgcggaccgcgcgaacgagcaggcgacgggcgagcagcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtcccttcagcaccgccgcgggagcccaagtccgagcgcagcccagcggaaccccagctcgagcccgggctcacggagagcagcgctcggcgttagccgcacgagcaacaccccgggtgcccctgcccagggggcccgccatctcctccaggaggcggggagaaggaacgaggagggcgggcgggcaggcgggcccgccgccggggggagcaggcagccaagcaaggagagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggacgggagcccggccccccaacccattttccccacctcccggggctcgctgctgagcccgcccccctccctctttccccctcactccctccctccctccctttctccctccctttctccctcccttctttcctcctctgcctcctccgctgccggaccagctccctcccacatctggctcctagagacccctgggatcccgcgcacattcccctggaccggcacccgacaaagcgcccggagaggcttggctcgctcgttggggtggccagagccgcaggcctctgttccccccgacggctggggggaggggggaagagggcgcgcgcccccctccccggcgccaactccccctggcggccgctcccatgggtgtcgctgggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcaggtaggaaacctcttagaggcatgtcgatctgacctttcacctctgccccctgtagcgatgattccagatccagtcagactgcttccttagttccgtgggtgaccccggaccccgcactcagtctggaggtgtggagcctgggggcccagggagatgctgggcggccaaattcagcaggcaagagcctgctagaggaacctcactggtgcccctgggtaaggaggttgacgcggttggtctcgtgatgttctgaagagacaacgcggcccgccaggttgctgaggactaacttagcaggagccaggggggctctgcttggtggggcaggagtccggtgtgagtctctgactcaggctactgacccggtgttgggacagagtgggggcgggtgtgatttggaaacgctagacagcctttgatctggtccttaccatggctcccttcaggctgtgtagatggcagagatggtgcatgggatctgggcaggagggtcccttgcaaaggcaggtgcaagggttctcacccccggcagagcctgtctccatagctgagtagaattcctgccctgatttcgggctgcccagctcgaggtccttcccaggagacgcctgtagccctccgtgacaagcttacttaccccatagcatgctgaaccaactcatcttctaccaccactctagagtttagcctttatctttaggaacctgttgaagtgactctagctttcacgttgtctgtttgggttgatggtcgagtgggagtttccggtgacccgatggaagcggctgccgagcaaaagactagagggggccaccaccctgggcagcttagatgaaagcgctacagaccagcaacagcctcccaccgagggttctccccgtttccagcggtagggactgcagcagcaatatagacatcccaaccagtgtacaaccactttcccgtgaattcactgggggccgggaggggggaggggggcatgaaacaatactagtcaccgtgggatatattctaatattccatggctagtggtttgttatgggactatctcagttttatgagaacctgcacatagcacataaagttgatcatggggctctggtccgaagatataaagcccatagtctacctctacccatggaataccatcgacttattctgtggacacagggatttcaaaggaacagatgacccagagaagaatgacagcactgagtaagaaggagtgccaggtgagcaggaggttgacgtgacaggtggcatttagtctatgaaggacctccccatgcccaggtctggcaggaggctgctggctagctcagccccaggtggggaagtttccccctggtttgggtggcctcccccagtggatgattgattttcttccctgctatcgcgctctctgacccaccaccccatcccaatcctcttctggctttaccccacagctatgctggcccgagcactaccctcaaggcccatttctttgcccatgggggtttcccggtcctttcaccctgccgcatacccttcccttcctgggatttctgtaggtgcctgagaggaacatggccaggggtctccgaggctgaaacagctccgagctctctgctttggattagctagttacttgatttcaggagctaccaacagggctctgggcctctaggaggaacgcgtgggctggcccaggccccagcttccatgtgggcctggcaagaagagctcagcctgagtggcatcactgtggcactacctggcccttcccctgcatcctccccgacactggatctttcaggagtgttgccccaagcacaggtgccctgggccagccagtcaagaatccccagtgctctccaggcaggcccagattcctctgtactcttggacaatgacagtattatcctgtgcggagtccccctgccccccagggagtgcagatgtgtttgttcagacatgcacaccagctaatcccaggacacaaaacctgtaaaacccatgcactcctgtgggattgcccctgagctccacagtctctccccagccctgcttttgagagccactttgccctggtcccaggtttcaggggcccagacagttctggcttggacagtctctgtggctgaggaagtatttggggccctcacaagcttgccctctggagcttggatgcctggatccctcctgcctcccccgtcaccaactgtgctcccaagcccttcccaagcactcacttcccggtggtgttggtgctgtcctgatatcctgacccccgaggctccagcctcatccctcaccagaacacttctccctccaaaagctggcgtgtgagaccccggctatccgccaccaagaggagttgcggtctttaggggcgttgtccccacctctgcaccccagagttcttcccattcaccttttttcctgcttgcagccatgcacctagatgggcatagggttggggtgagtttgtgggagagtgagggggaggccaggggcaaggaaggtaaatgtggtggccccacaggaattgtgagagatgagatgcagccccccaaggcctttccagtctcactgtacccccaaggcagtctagtggcctcgccaaaacctgagcttctccaattccacttttaaaaccagagttaggggctgtgtgtggcacgctgggttctgagggcatccctcccgcccccccaggccagcccccagtggtgccagcagcacctgcccctcacctccacctcttggtctcgtctgaagcctcagtctgtgtgtctgtcccagggacaatctggtctcctcctgtgtgctgtggctggcatggcctcagtgtctgagggcttgtcctgggaggggtatcaagaatccaattctcacctggttgtaggacctcttgggggatgctaggagggcgccctggcacagccagggattgcctagggctgaggggcccaggagaagctacttctctcccagaaaggggctccctcctgcatctgcagtcggatgcccagaccgcccactctggacagcccacaatgcctcctccgtcctgccatgcccattcgcatgtgtcttgtccatctccgctcctgtgatgtgggtcagtcctttgtggtgccgcgtccagggctgcagggtcccacgtcagtgagcagtgggtggccggtggagggggtggtggtggccgggctcccttcctgcccatggcacctagaacagcagtgaggtctcagagaagcccccgcctgggctccctgggagctaaccttgcagcctctgggttatctttggcaaaggggtctaaagtcccctatccccagcccctctacttcccctgctgggcagcagtggctgcccagtgagtggtgctatccatggaggggggagggagctgggcagcgctgactaggcggcgggtggggctaagagagtttctgcagggacccagctgcagggtcagcagcctgtgggccctgagtggggtctttgttgtcctcaggtgggctgtgggggaagtagcggagaaatgaagtgacgccaggggccaggcatgggtgttcttttccgtgttgttcacattttctctctttctctctctctccactaatcatgtttctctctctctcctcgttttgttgcatgacttgtgccggttctcgtgattgttccctgctcgtgtctcacagactgtccccatttagcctgagacttttttcctgagtccccagctgggcagatccctcagggctaaacccaaggaaatgcccagcaacccccaacccaccccagccccgcgtgcgcccctccggtgcccgcagctggtgtgaacagtaagtactttggcggtgcctggagaccagggcagaaaagccagctgtgctgactgagggcccagcctcgggttctccttgctccaaagtttaaaaaaaaatgaccctctcgcagatgctcatctcagcccatttcaagcctggaaaccatctctgagacgctgcccatgctgccatttcatcactgcaggcctgtgggtctagtgggggcctgggggccctgggctgggggaggcagggcccccagcctctggaaagcaggtgggaatggaggctcctagccactatctcatccaaaggatggggcaggggcgggggctcacacctttgaccctattcatgggttccccagatttatacagttggcccctcgttggtttctctttcttcaagccacccctctggagttggggagggagaatgccccagtttctgaaagcatcttaaaccatagatagacgaacagcccaggggcctgggccccttcacagagcaagacttaagcttccccacccaatcattagtccctcctcaaaggttagggttgagagaagcagtaggccctaggggtgtcccgggaatcccccaggagggaaaggtgccaggctatcatccctccagggatccctgatggatgttccttgtcccctgcccaaaaccatcccgaactttgggccctttagtgattgtgagagctgggagcccccagggcctgggggcttgtggacagaaccagtgggcgggggcccagcattcagagccagagaagggtctcaggcggcaccatctccacagaggcagaggcagagagaaggcacccccctctgacccacccctccccaggcaagaactgcaggctgtggacacctcccctggcagaggatggccaacagagactcagcaagtcctcactcccctcccagaaggagacgctgcctgggaggacccactgttctccccttgaggaaaatccatgcagggtgctatgggcctcaacccccacatcgtcatccgcgtcctctccatactgtttccctcccctctcccaacaccctcctccctcagcccggagacccttggatggaagactgggccagccagagtgggaggcaggaccagcgtgtctgcgagcacacgtgtgtgcctgcagacatgccccaagaccccagagacgccccggccccagtcacatggtgtcagagttaccttggcaactggcctttttggttcagagtaaattgggaagtgaagcccctgggatttgtcgagaaacgcactgtacgtgaaatgctttgccatcttgtacgaaagactttttttttaagttccaaaattatgatgggatttttttggatttgctttacgaataaatctgattggtccatttctcttttga

SEQ ID NO: 10414 - DNA, 4295 bp, Homo sapiens
  ENST00000265969
gaacgagcaggcgacgggcgagcagcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtcccttcagcaccgccgcgggagcccaagtccgagcgcagcccagcggaaccccagctcgagcccgggctcacggagagcagcgctcggcgttagccgcacgagcaacaccccgggtgcccctgcccagggggcccgccatctcctccaggaggcggggagaaggaacgaggagggcgggcgggcaggcgggcccgccgccggggggagcaggcagccaagcaaggagagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggacgggagcccggccccccaacccattttccccacctcccggggctcgctgctgagcccgcccccctccctctttccccctcactccctccctccctccctttctccctccctttctccctcccttctttcctcctctgcctcctccgctgccggaccagctccctcccacatctggctcctagagacccctgggatcccgcgcacattcccctggaccggcacccgacaaagcgcccggagaggcttggctcgctcgttggggtggccagagccgcaggcctctgttccccccgacggctggggggaggggggaagagggcgcgcgcccccctccccggcgccaactccccctggcggccgctcccatgggtgtcgctgggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgactttcacacacgttgttggagccaaactgtaacggcgttcagtagaaacctgtacatttctgggggtgaggggcgaggggaggagggacagagatggggaatggattgcttcctttttgtacacaagatcaagaggaaagcttccaaaaagggcagtcggtcagtcatcggtcatattgacctcaccttcatagttcatctctcacgtggaaactgagaactttgctccaaatagaattgtggaaactcgcacggctgccttcttccccgtttggcatgcttgtgacccagcggatgtctccccaagacccctgacagcagctagtctaggttgattctctcatcttatcggtgtgtagatccagtgtgaccaactttcataacaaattgttcatagtaaataatcaccaccgtatggattttccaagtgttccattaaaaccaggatgtagagcaccaaaagatcaggaccacgggaggagcagcctcctccacctttactaaggcacaacctggcattgtatgcaatttagtacttcagagtaaaaacctgcatgcccaatgttatgcaaagcgattctagcatgaaataaattttgtatcatggtttctgtatagtctaaagcagatttgttttcctgaagcagtcggaggtttgcagagacacacttctgcatctcgaataaatatagtattttcccaacagaaacagaggacagtagcttggctttggtctgattctaaaattagtggggtgggggggaaggatgatatttttgaaaaacacatgcttgagttgaaaaaaatgcaacatctcaagctttcactgcagctcacaacatttcctggaaagagagcaatgatgctttagctcaacaacctcccctccctgggccctggcccccaataataaaaaactgacttttgagatgaa

SEQ ID NO: 10415 - DNA, 2736 bp, Homo sapiens
  ENST00000640318
tcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaagggtcactctgcagaaatggacaactccatctggtttttcctcagggagacagagccttcccatgtatccacgtatggagttcctattgaggactcaacctttgcaatagcttcttggaatctggaaagtctactaagtaacaggcggatagtatatacatcatggacacactggacaaagagatgattcatgttctgggtgggatggagtgacatggcatgagatttcatcacgctactcaaaatgtgaaacttttgcattatttctggaattttccattgagtattttcggactgtggctgactgcaggtaacagaaactgtagaaagtgcaactgcagataaggggaactactgttctccctctgagacacgatttgaagcaaaggggcctgggctgagtggtgggagatctgctttcttagtctgcctgggcaggtcctctggctggctcacaactgaaacatatcactgccccttctaagacttgaatatttcacttacagatgaagattgggaacagttggcttctgagatcctttccagcaccaacccactttaattctataaacccaacattcccaagtataccatggtcatctgtactttgcaggctctctctagaatggacaaaggttattctgcagtgtgggcacagatgtggtcctgtaatgcaagatactgaaaaccacatccccacccctaacccacaaatttcctctctaggcctcttttataggaatgtcttcagactaccccactgcctatcccactgacaatttaaaggcaatataactaacaagctcatcctttaccctctgtcaatatctctgctgcccatggctggctcccctgtgctctggcctccctagtgcaagctgactcagtcaatacccaagacttaccatttctaccactaggccctctcttatattgattcccaattacacattactttgttgacttcttttcatattccaccctttagatcctgaattcatcatcctttgtgtaataaattcccagttttcagaaaaagtgaaatggtccccttctatgccttcatggagacaggctgcagctggagccttttggcagccaaaagagacccctttgcagctcttaacaatctgttactgaataatttgagagaatattgctaattatgaacctgtgtctttagatacccaagtccttaagctgcagagtacccaggacaaggttctcctccttgagcaagttaccctctctgccatagtttccccatctgtgaaacaggtataataatagtacctaccttactgttgatgtaaagaatcaattaataatgtatgtaaaatgtgtaaaaccacacatagatcaataatgtcaactattactgttattatggttcaataaatatttgacag

SEQ ID NO: 10416 - DNA, 889 bp, Homo sapiens
  ENST00000640153
cccaggagggactggcctcccagcaggcctggatcctgggtgtggtgggactcagctgctgcaggcatggcgtgtagaagggagataaagtctgacagtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaa

SEQ ID NO: 10417 - DNA, 1270 bp, Homo sapiens
  ENST00000640909
gactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtcactctgcagaaatggacaactccatctggtttttcctcagggagacagagccttcccatgtatccacgtatggagttcctattgaggactcaacctttgcaatagcttcttggaatctggaaagtctactaaggtgagttcgtccctataaaaagggaccaggaggctgggcacggtggctcacg

SEQ ID NO: 10418 - DNA, 2530 bp, Homo sapiens
  ENST00000639495
ccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcaggtcactctgcagaaatggacaactccatctggtttttcctcagggagacagagccttcccatgtatccacgtatggagttcctattgaggactcaacctttgcaatagcttcttggaatctggaaagtctactaaggtaaaaattgataactggatcatgctaagttctggcaaggatgtggagctatagaaatctgcatttactgcttctgtcaagcatcaggcactaagctcagtcctttatatatattatcccgtctaactgtcatagttgctctgagcattttcattctttatctacatagggaaactgaggttcaaggaggttataattcactcaacgttgcattgctaggaaggagcagagctgagtttctttcatggacttagtgtccctctcaaaatcacgtcaacttcatttgaaaattataatgaaactattaaaactataatattcttactttttatacaaaattattatctttcttttccaaccatacttgtacttgttacaacctcagaaggcctatataaagtaaagcgggggagtaggagagccagagtattatctttattttatagatgtgctattggagcccttggagggcgagtaaattacttaaggtaatttaaatttcattttaaaattgaagattaacaaaggtacctggacagtttaaggagccagattaaaaagacatcttcactaggggacagtcagtactggatttggaaactgtcacagttttaaatacagtagtgcccccttatcttcaggggacatgttccaagacccccaagggatgcctgaaatctcagatagtaccaaactatatatatttgctattttttcctatacagtaacaggcggatagtatatacatcatggacacactggacaaagagatgattcatgttctgggtgggatggagtgacatggcatgagatttcatcacgctactcaaaatgtgaaacttttgcattatttctggaattttccattgagtattttcggactgtggctgactgcaggtaacagaaactgtagaaagtgcaactgcagataaggggaactactgttctccctctgagacacgatttgaagcaaaggggcctgggctgagtggtgggagatctgctttcttagtctgcctgggcaggtcctctggctggctcacaactgaaacatatcactgccccttctaagacttgaatatttcacttacagatgaagattgggaacagttggcttctgagatcctttccagcaccaacccactttaattctataaacccaacattcccaagtataccatggtcatctgtactttgcaggctctctctagaatggacaaaggttattctgcagtgtgggcacagatgtggtcctgtaatgcaagatactgaaaaccacatccccacccctaacccacaaatttcctctctaggcctcttttataggaatgtcttcagactaccccactgcctatcccactgacaatttaaaggcaatataactaacaagctcatcctttaccctctgtcaatatctctgctgcccatggctggctcccctgtgctctggcctccctagtgcaagctgactcagtcaatacccaagacttaccatttctaccactaggccctctcttatattgattcccaattacacattactttgttgacttcttttcatattccaccctttagatcctgaattcatcatcctttgtgtaataaattcccagttttcagaaaaagtgaaatggtccccttctatgccttcatggagacaggctgcagctggagccttttggcagccaaaagagacccctttgcagctcttaacaatctgttactgaataatttgagagaatattgctaattatgaacctgtgtctttagatacccaagtccttaagctgcagagtacccaggacaaggttctcctccttgagcaagttaccctctctgccatagtttccccatctgtgaaacaggtataataatagtacctaccttactgttgatgtaaagaatcaattaataatgtatgtaaaatgtgtaaaaccacacatagatcaataatgtcaactattactgttattatggttcaataaa

SEQ ID NO: 10419 - DNA, 660 bp, Homo sapiens
  ENST00000638366
aagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagggatttcaaaggaacagatgacccagagaagaatgacagcactgagtaagaaggagtgccagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagagg

SEQ ID NO: 10420 - DNA, 1541 bp, Homo sapiens
  ENST00000639325
attccgcggccaccgcagctgggatctcccaattattgtaaatctgtcgtaaactctccacaccacagtactcagagtgacacatgtccgctggcccaggaagaaattttagaaattaacagagcaggtcactctgcagaaatggacaactccatctggtttttcctcagggagacagagccttcccatgtatccacgtatggagttcctattgaggactcaacctttgcaatagcttcttggaatctggaaagtctactaagtaacaggcggatagtatatacatcatggacacactggacaaagagatgattcatgttctgggtgggatggagtgacatggcatgagatttcatcacgctactcaaaatgtgaaacttttgcattatttctggaattttccattgagtattttcggactgtggctgactgcaggtaacagaaactgtagaaagtgcaactgcagataaggggaactactgttctccctctgagacacgatttgaagcaaaggggcctgggctgagtggtgggagatctgctttcttagtctgcctgggcaggtcctctggctggctcacaactgaaacatatcactgccccttctaagacttgaatatttcacttacagatgaagattgggaacagttggcttctgagatcctttccagcaccaacccactttaattctataaacccaacattcccaagtataccatggtcatctgtactttgcaggctctctctagaatggacaaaggttattctgcagtgtgggcacagatgtggtcctgtaatgcaagatactgaaaaccacatccccacccctaacccacaaatttcctctctaggcctcttttataggaatgtcttcagactaccccactgcctatcccactgacaatttaaaggcaatataactaacaagctcatcctttaccctctgtcaatatctctgctgcccatggctggctcccctgtgctctggcctccctagtgcaagctgactcagtcaatacccaagacttaccatttctaccactaggccctctcttatattgattcccaattacacattactttgttgacttcttttcatattccaccctttagatcctgaattcatcatcctttgtgtaataaattcccagttttcagaaaaagtgaaatggtccccttctatgccttcatggagacaggctgcagctggagccttttggcagccaaaagagacccctttgcagctcttaacaatctgttactgaataatttgagagaatattgctaattatgaacctgtgtctttagatacccaagtccttaagctgcagagtacccaggacaaggttctcctccttgagcaagttaccctctctgccatagtttccccatctgtgaaacaggtataataatagtacctaccttactgttgatgtaaagaatcaattaataatgtatgtaaaatgtgtaaaaccacacatagatcaataatgtcaactattactgttattatggttcaataaatatttgacagttggtca

SEQ ID NO: 10421 - DNA, 537 bp, Homo sapiens
  ENST00000640461
ctccacaccacagtactcagagtgacacatgtccgctggcccaggaagaaattttagaaattaacagagcaggtcactctgcagaaatggacaactccatctggtttttcctcagggagacagagccttcccatgtatccacgtatggagttcctattgaggactcaacctttgcaatagcttcttggaatctggaaagtctactaaggtgagttcgtccctataaaaagggaccaggaggctgggcacggtggctcacgcctgtaattccagcactttgtgaggccgaggcgggtggatcacctgaggtcaggagtttgagaagcctggccaacatggcaaaacctgtccctactaaaacaaaaacaaaaaaaacatatatacacacacacaatttagccaggcacagtggcgcacacctgtagtcccagctactcgggaggctgaagctgaggcaggggaaccgcttgaaatcgggaggcagaggttgcagtgagccaagatcacaccactgcactccagcctgggggacagagc

SEQ ID NO: 10422 - DNA, 3102 bp, Homo sapiens
  ENST00000638825
tccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaagggtatgtagaggaagctggagcaccgtgcatcgtccgggccgcctcgcgctcctgcagatgggtgggcagggcggcgggcaagggcgctgaggggcaggcaggcacaccgaggggggcaaggatggagggaatctcccagggtcggcccctggagggctgaggcccttccccccaagtgagatgtcaggctggcagagagaacttgaggccctggcagctgtgggttgctgggagttgagaggggattggacaggttgactttaggccatgaccccaaggcaggggtacccaggaatgcaggaggagccttgactcccccaggctgctcttgcagatggcaggtcaagtcccaaaggcaaagtgatctctcctctcccctgattgaggagggcagtggagtgggccaggaccctgtgaacttagctacacaagatccgtgttcttggcatggaagaggcatccttgaaagataatcaatccacaagccagagggaggagaggcaagaagagagagatgtcttcagggcttgggggtaaggccattgtccttgcagtcagaatattgctagtggcagatcgagaacttgccaagagaaggtggttgagcaggacggtcctgccccttccatccgcagcacccacaggcctctgcccagggtgtggtcagcaccctcttgtggttggcgaaggctgaggctgctggtggcccctgctccaggtctctttgtagtcagcacgctaggctgtccccactggagagagaggcttctcctagagcttcagcaccggccggggagaggcttggggtgggggcccagggcgcccgagctcaaggctccaggcactggcccggacctagaaggcagagggcacctttcttggtgcagcagactggctgggcagctcgtgcatgtcttggagtgcctcacacgtgcacacggatgcatgctgaacggggtgagcaggctgggtcagaagaggagctgggtttttgaaagcaacagttggtgcagcctatggtcattcacaactgctccagtatttgaagtgattaaaccacacgcaggagaaaacagaatgcaaaagcaaaggcaaacctagaagaggagaggcagcccgcacggagacgagggaacgtggttctggtcactggtgcttagttgtgcccacctggtctaggctggtctctgcttctctgccctgcccagaggtcctttgagccggggcacggtgcgcaactccccgcatggtgctgcatggcggagggctgccagccttcgggagggtcccatccttggcaccggccatggatgggcctgatgttcccctttgcgactggctttttcccagttggaggtgctagaatgcccagaagcagaatgcccgaggagtgaggggaaaagcaggtagacggttcccagtgtctgtgccctgcccagtaagctctcgtgggctttctgtctccatcatcttgaatgttagactgattggtgtggccccaaagagcagacaagacagtctctttactgtggtgccagaagcacagaagggagtgtgggacaggaacagcgctgctccctgcagtggctgggagtccagcggtaagcactgtccacaggagatacccattcctcagtcccaccgaggcttaggtgccagagtctttgggaggcgctaagggtgaagtgtccccacctacatccattcggcccgcgctctcatggagccacgacagccgccgaggacttgtttttctcaggctaattctgagccagaaggcatgcaggtgtgtgagtcaatgtgcagagcagaagtagggactcatcccattcccccaggagggagagaaagaggcgtgctaggctggctcagtgcatgggcaaaccaagccagctggagaagaatctgcctgcctctgcatgcggctgttctgtctttcctcctccttcttaaaaactaagtaccaagcgggatgggagagccaagaagagaagctcaagtgttaattgtattctttacatacagatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgactttcacacacgttgttggagccaaactgtaacggcgttcagtagaaacctgtacatttctgggggtgaggggcgaggggaggagggacagagatggggaatggattgcttcctttttgtacacaagatcaagaggaaagcttccaaaaagggcagtcggtcagtcatcggtcatattgacctcaccttcatagttcatctctcacgtggaaactgagaactttgctccaaatagaattgtggaaactcgcacggctgccttcttccccgtttggcatgcttgtgacccagcggatgtctccccaagacccctgacagcagctagtctaggttgattctctcatcttatcggtgtgtagatccagtgtgaccaactttcataacaaattgttc

SEQ ID NO: 10423 - DNA, 525 bp, Homo sapiens
  ENST00000525802
ctgggggccgggaggggggaggggggcatgaaacaatactagtcaccgtgggatatattctaatattccatggctagtggtttgttatgggactatctcagttttatgagaacctgcacatagcacataaagttgatcatggggctctggtccgaagatataaagcccatagtctacctctacccatggaataccatcgacttattctgtggacacagggatttcaaaggaacagatgacccagagaagaatgacagcactgagtaagaaggagtgccagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaagggtatgtagaggaagctggagcaccgtgcatcgtccgggccgcctcgcgctcctgca

SEQ ID NO: 10424 - DNA, 849 bp, Homo sapiens
  ENST00000638395
agtggtttgttatgggactatctcagttttatgagaacctgcacatagcacataaagttgatcatggggctctggtccgaagatataaagcccatagtctacctctacccatggaataccatcgacttattctgtggacacagggatttcaaaggaacagatgacccagagaagaatgacagcactgagtaagaaggagtgccagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgac

SEQ ID NO: 10425 - DNA, 1859 bp, Homo sapiens
  ENST00000526029
ccacacctgctggatccatcaccaactcatctttttgcaaactttgagcaaacccaggagtccccactcccagcactgtgggcagcccgaaggctgcctgaatgagctgaaccccccaccaagccccctgccttgtgccctcctcgctccacagcctgcccgcttttccgtcctcagggacgctcaagctgccctctgccaataccccgcttctggcctgtccccccctgccccccactaaacagttttcagtgtctcaatagcttctgcttatatgtttgaagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgactttcacacacgttgttggagccaaactgtaacggcgttcagtagaaacctgtacatttctgggggtgaggggcgaggggaggagggacagagatggggaatggattgcttcctttttgtacacaagatcaagaggaaagcttccaaaaagggcagtcggtcagtcatcggtcatattgacctcaccttcatagttcatctctcacgtggaaactgagaactttgctccaaatagaattgtggaaactcgcacggctgccttcttccccgtttggcatgcttgtgacccagcggatgtctccccaagacccctgacagcagctagtctaggttgattctctcatcttatcggtgtgtagatccagtgtgaccaactttcataacaaattgttcatagtaaataatcaccaccgtatggattttccaagtgttccattaaaaccaggatgtagagcaccaaaagatcaggaccacgggaggagcagcctcctccacctttactaaggcacaacctggcattgtatgcaatttagtacttcagagtaaaaacctgcatgcccaatgttatgcaaagcgattctagcatgaaataaattttgtatcatggtttctgtatagtctaaagcagatttgttttcctgaagcagtcggaggtttgcagagacacacttctgcatctcgaataaatatagtattttcccaacagaaacagaggacagtagcttggctttggtctgattctaaaattagtggggtgggggggaaggatgatatttttgaaaaacacatgcttgagttgaaaaaaatgcaacatctcaagctttcactgcagctcacaacatttcctggaaagagagcaatgatgctttagctcaacaacctcccctccctgggccctggcccccaataataaaaaactgacttttgagatg

SEQ ID NO: 10426 - DNA, 2931 bp, Homo sapiens
  ENST00000550433
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 10427 - DNA, 3026 bp, Homo sapiens
  ENST00000548513
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 10428 - DNA, 5625 bp, Homo sapiens
  ENST00000549446
gtggagagtggggtgtaaataaggcaggcagaagctccagagagggtggagacagagcttcacggaagaaaaatatgtgaacctggttggtacacatagcttctccagacccacccacccactctttcctgagccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcagaaatgccacttgggtagctaatgaatcttacccaggctttaaagattgtctaaagtagtgctaagatccctcctattaattgccctgatatccttttgcaataaaatgacagatagtgtcagatattgaccagtgcactaatatataaacataccttcagggagatatatttaaaacagtgtgcttccaaatgccaaccacttcattggaactttatttcttgtgactgtaaaccattctgaagatgtctgggatcctatcttgattgcacacgacatgacttgtgtcagctcatttgcatggaccatcttgtctctatcacctgaaagcaatgttgcagagttcggggactgtggatagctcaggatatgtgtacttgcatcgaaccatcctgctgatatgaaagcattggtcgactgttctgcatgttgaattgtggggcagggagggcacttttctccttgacatttttttcttattatttgaaagaaatatatgttttaaatagtttaatttcttgattgatttacttttcttcaaaaatgctgtattggagttctgaatgtctctggttgtttgcacacagataactgcaaagaggttgtcattactggttacacgcaagccgaggccagatctcttacttaatgacttggggaaggcacaaaacatgagagaaaggtaactgccagccaggcttgcattgtttagccagaaattgctgcttggttctagactctttaaaaaaaaaaaatacccagggtttgtcatcattttcagaggcagagtgccaaatatcacccaaagctcttgtgtcttttttttacccccttattttatttttatttattaattttttgtgcaaacatcaaatgtcactggtgttcacagaaggcttttttgactagccttaaattcctgagtcaaaagattaatcagattttcaggcagtgtttaatcaggtgctttgtcctgtatgttgttcttgtctgtcttagctccctgtctttcctgtatatgccatctgtctccatgaagcacagaaatgcctctgtaagatgtttatgattttaatatttactccctccaaacccgactccataccattttttgctatttggagcagcctctctgctttgtgtataaattaatgatgctctgtagactacctaagttaatcggcactgtgaatctttttgataagcagggtttaagcagcaatttcaccattgcacttggttgcctgctgcagtgtcagtttctactacctagcaaccagcattcattactacactccaacaaaatccttagggagtcatattcagtctgagtggaagaaagtctatttatgcattcctatgaattcaacagcaatagcgtgtctcatgtattgagcatgtgagggaagaaaaagaccgtaatataaatagagggataaataatatcactaaggcatttgggagccttgagactgctgattaattcctatttctcatgtttattttttgttaggaagacaattgtcacttttattattggccacgaaacatgtattactctatatccccaagtcctagagcatgacctgcatgttggagatgttgtacagcaatgtatttatccagacatacatatatgatatttagagacacagtgattcttttgataacaccacacatagaacattataattacacacaaatttatggtaaaagaattaatatgctgtctggtgctgctgttattgactacagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattat

SEQ ID NO: 10429 - DNA, 3344 bp, Homo sapiens
  ENST00000350228
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggg

SEQ ID NO: 10430 - DNA, 2168 bp, Homo sapiens
  ENST00000540018
gaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcag

SEQ ID NO: 10431 - DNA, 2485 bp, Homo sapiens
  ENST00000393288
agatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggaattagaaatgggcattccatcctacatcacctggataatggcaccaaatgccattatttaagaatcatcttttaaccctataaagctggaagattaaatatgctggaaaaagagttgtccatttaaacttaagtatgctttattggcttaggaaataaaaaatgaaaagagaaaaagtagcctacttatttctctttttttcaagaatacattctgaaatttaaaaatattagtcaagcttatatcttacttaagttgctttgcctaatttttaaatgagttctagtattctatatgccaaaattatattaatgctaactataatctgggaaaaaatatattttgaagtattgtaacaataatttgtgatggctggtttaatcttttcaaaatggcaactacagtgagcttcatttttttagagttataaattgtctcaatattaaattctttgt

SEQ ID NO: 10432 - DNA, 572 bp, Homo sapiens
  ENST00000548243
aagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcaggctccccatcagacgctctagtaccagagacaaa

SEQ ID NO: 10433 - DNA, 534 bp, Homo sapiens
  ENST00000546456
gaagctatgtgaagaacagaagtgcccagaaaaaaaagtccagacattagagacggggtttcaccgtgttagccaagatggtctcgatctcctgacctcgtgatccacccgcctcgacctcccaaagtgctgggattacaggcgtgagccaccgcgcccggccgataaattcttattaagggaaagcaagtggcttcagcacatacagaaccaaaccctgaacacagaagatcaagtttcatgcaggaagatttgaacgctttgaccttttttaagaaatgtgtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaa

SEQ ID NO: 10434 - DNA, 3563 bp, Homo sapiens
  ENST00000298972
actctttcctgagccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaatt

SEQ ID NO: 10435 - DNA, 5447 bp, Homo sapiens
  ENST00000376959
cccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcatttaaaaa

SEQ ID NO: 10436 - DNA, 3347 bp, Homo sapiens
  ENST00000474951
aggtcgcgacggcagccacaggtggcagtcgggggtggctgtaattgatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcattt

SEQ ID NO: 10437 - DNA, 3176 bp, Homo sapiens
  ENST00000477616
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgc

SEQ ID NO: 10438 - DNA, 7396 bp, Homo sapiens
  ENST00000369697
tttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggataggccgggggatataggctatgtgccaggacagggcctggatggaggagcctcagactcagaccaaataacagtcgtttctggagaccccagtgaggaaaatacaagaccaagagcagcaaagaggccaagttgtcacaagcaaaacaggaagaaaatataacactgtgtatttaagcacctttttcaaggctcttaatggataatatttattcatgggaaaaggtggaaaacaaaaacaccaacggatttttgtgaaatgtttttctccatggacccaacacctttgaaccaaaacaatgcattttgtgagggatttttttttctccttttatagcaaaagcttttaggctaagaagtcagttattgctgagttctctctccattcccccaggtgggtgaggtcaactgagcctgggcccccactgcccagctgacctgtgcagagctgccaagtgaccacacggcaatccttaccctttgtctgtccctgtctcccttgtctctgtacctctctgcttacccctagctgtttctgtgtccagccatctgtctctacctggatcccaatgatcctgaaacacatcagtaaagccttcttcatcactgccacgcacaacagacttgtgcctgggagttctatctgtgtgaatgcaactgcagaggaggaaagagtgaagcaaaaattgggagagtttaggggtaagggaagtctacctcacagaacagaggtacttcccttggggttggaaccactcgtgtttgcagtttcagtttctgggaaagaaagggaatgaacagatttatcacactggaatcttgaaaaggcaaatcgccaacacctgagacgcggtcaactctggtatgtgccagtgaggggagaacggaaggacccagggctcgcagcctcagccggtcattagggcaccttgctatggacccttccttcaagacccaccataaagcccatccagagcccttccaagaggccccgggagtagttttctccagagagggcagtggtacggggaccaagattcctctgacttatatcaaaccagaggcaactcccacacagaggctgtggaagggtaagcctgtgtgcctcaagaaaaatgcttcaaagcaaaagcaagtaagagattctagatgattcttacctgctatgaaagatgccttgatgtctgaagaggcttcggcctgatctccctgaagatgctgaaatgggggagaagcctcatcacctctgtgcaagcaaaggagtgaagattatttcttgaacacctggacaacatatctattcaactagcttgcaccctggtggagctgggggcagcatttctggaatcctcctaaccattgttcactgcttgtagcagagtaggtgggcctcagggttagtgacaagtcctttcctgcccttcccaacacccagccaccttgctgcagtctctgtagcctgggctctgaaatacatgagctcctcgggagctgcctatccatcctacagcttagtggttagctgtttaattgtaggccaagaatttctctccccaccacagccatctaaatgagttttactagccaggaacctaaaaacacccttcgtgggcttccctatgaccccagctcgattgaccctgtaggttcaaaaggtttcgaggtggcacctaaccagaatgtgggcagaaggcagaggagagggagccttctttctgtctttatctctttatgcttatcctcattgaccatgggctgagttctttctctgggtcccctaatgtgggaatggagtggttcttgccctctgagcttacagactaagaaggcagaaaagctttacaactacagagtacatgtgtatacacacaaccaacctaaacacatcagagaatacatacttaaatcaattcacttcatatacacatctcattagaagaccaagctaaacttcacttagagggcgggcaaaggactagaaaagaatttttctcttaaaaaaaatgagtactagagcaaaattatgagtgtctaagtatcttagttatgcttcataagatctgactggggtaagagataaagaggtaaatagggctgggcgcggtggctcacatctgtaatcccagcactttgggaagccgaggtgaacagatcacctgaagtcaggagttgaagaccaacttggccaacatggtgaaaccccatctctactaaaaatacaaaaattagccaggcatggtggtggacccctgtaatcccagctacttggaaggctgagggggaggattgcttaaacccaggaggcagaggttgcagtgagccgtgattgcaccactgcactccagcccaggtgacacagcaagactccgtctcaaaaaaaaaaaaaagaaaagaaaaaaaaaaaggaggtaaattagaactggttgcacacacatacaaacttcctgtgatgaatttaagaacagatcattacagggttagaatagtgacagattcaacaaaggatctgtttgatagggcaccaagggaacattttactggttcccacaaaaattaataaatgttaaatatcatgtcccaagcaatttcccatgtttttttattggtcctaatcaacagaatgttttgtgttccttccacttcacgttcagagcccacgtcatgccacttcctaaaagaccattagaccatccccttttcctccatcctccactgtagccttagccagagaaaagatccagctcacttctggtccaaaaaatgtcaacgtttggaaaatggctcatctacactacagaacacagccagatgacactgctaaagggtactgtaagaaaacacaaggtccaaagtatgctgaattggtttcataagtctaactcattggccagtgactgaaaaaccaggatatcaggattttctgggggccaatagccatgacccttgagctttcatagttcatgaaccactttgacataataaaatattcccaaaaccacctattccattcagtcccactcagcattaagagggggagggaaaaacaaaccaaccaaccaacctaacagttacattcaaatgtcaaatgaatgtgaacctagaaaatgtagtattaagagcatatcagaactagaaaagatttaagaatatctaattcattttacagtatagaaaactgagacccagagaaattaaatgacttgttcaaggtcatgcagttatttaatgacagatctgagaccagaacacgagtcttttggctattagtctaatgcattttctaccacacccactgcctctgagagcagtgatgctttggagaagatccatcaaagaatccatactgtaattggagacatagtcttatatgtcaatacgtatatgtcaatactacttggacacagcccttggaaatcacctgactgtaccaatacaaaccatactttggaaaccaccattctctgggtagaaacatctatggactatcaattttgtcagaaatcagtgaacaagtgaagagtcaattttttttagtcaaatattttctcttctcaatgaagagaagactaggacagtgacattttgaagcataccttttatactccttgtggttcttatgacagtctgtgatggtagtaggtaaagtagctaaatccttgattcagagaggggaaaacatgtggaaagaaactgaacgacttatccaagttcacatgacaagttagtggcagaaccattattgcaatccaggacttaagacatcttgtcctaggatttttcctccacattatattgcactgctctgaggcttgcttatatttttcatacctggatttccagggtggtgacgtgggggagggaagtattcaattcagaaccaccgtgaaccaagatctctggaaacaaactctgtactatttctccttcatctcctattttcataactagtgccaagctcaggactaactgcatagactccctttcaaaagaccaatagatattctcagtgacagttgaacacattagtttacaatcacacagaatttgaacagaacttaaagttgacagttaatgccgatctataattaacaaaaatgtcaacttgtggatatgctgatgattttatccagttttcaaaatatgattcctacagttcaggatatcacttattagattgtagacaaggaaaatgtacattgggacattatgtacttaagagtttttccttaagttttgcagaggaagtggttgaaaattgagctaacactagatttcgaggttactaaagaattccagttttccagtctcccacttcaattaccaggtaactataaggcaaaaatatcccaatgctgtgaacttaaggcaatattcatttcctttctacactacttggcatggtaaccatgacaaacttttattttctctttctgatttcctaatgaaatctcattatttgcaaagctttaaaatgactagatgaaggaaaaacattgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttcttttgaaactgtagtgcatatgttaaaacatgtatatcatttacagtattgagtcgtgtgccactgctgtacctgatgtatccaatctggattaaacaaattatgtgccacaaaccctaaaa

SEQ ID NO: 10439 - DNA, 2716 bp, Homo sapiens
  ENST00000315987
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactgggttgtcctatcttgtggatgatcccctgttatctgtacgaacctccaccatcaagaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 10440 - DNA, 2659 bp, Homo sapiens
  ENST00000302127
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 10441 - DNA, 2289 bp, Homo sapiens
  ENST00000295082
ttgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcagccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgca

SEQ ID NO: 10442 - DNA, 5179 bp, Homo sapiens
  ENST00000308251
gctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccagggcgaatgctctcggaagtgctactatattttcatcgtggagaccatctgcgtggcctggttctccctggagttctgcctgcggtttgtccaggcccaagacaagtgtcagttcttccaggggcccctgaacatcatcgacatcctggccatctccccatactacgtgtcgctggcggtgtctgaggagcccccggaggacggcgagaggccgagcgggagctcctacctggagaaggtggggctggtcctgcgtgtgctgcgagcgctgcgcatcctctacgtgatgcgcctggctcgccactcgctggggctgcagacgctggggctcaccgtgcgccgttgcacacgtgagttcggcctgctccttctcttcctggccgtggccatcaccctcttctcccctttggtctacgtggccgagaaggagtccgggcgggtgctggagttcaccagcatccccgcctcctattggtgggccatcatctccatgacaacggtgggctacggggacatggtgccccgcagtgtgccaggccagatggtggccctcagcagcatcctgagcgggatcctcatcatggccttcccggccacgtctatcttccacaccttctcccactcctacctggagctcaagaaggagcaggagcagcttcaggcccgcctccgccacctccaaaacaccggtccagccagtgaatgtgaactcctggacccccatgtggccagtgaacatgagctcatgaacgatgtcaatgacctaatcctggagggcccagccttgcctatcatgcacatgtaactcagcaccccccatgactacatggtaacctcaacccatcaccctgcctgaaacacactcaagggtaccccgcatagaccacctggtggtgtttctagagcccagggaagactttcaaagctggaggggcataaggccacagaggctgtgtgtctgtgatccttgtccctcggggccccgatgtcccaggctgactgtgtccagcctgcttgccttttcctctctctgcccatctactgagcatgtccaatcttgctggagtagctcagtctcctttcattctcttttccttcccagcagaggctttaacatcccaggctgggttctggatgcccatagaactggtaaccattggtatttgcatactgagcctatgtaatttcatgatttccctaagaccctccttcctgggccatgccaccactggaaatcaaaggtccagtcactgcaaacccctctaatcagatctccccacccaacctttccacgggttccagagggatcaatatgttctccttctgctcaccaccaccagtgatatttccctaatgctgctacctcccgccagctctgaacacttgtagctaagaaggcagaatcagcctttttgcagtaaatctcatgttgaggctgatgcccccaagcctgccatcctttacctggagctcaagaaggagcaggcatccccaggcatgcctgggatctgtgacctgggacctgggacctgggacctgggcagaaactccactttccagcacagccaggccctccctggccgcctggactcttggtgtggtgttctccagttatccagtccttagccttgacagagacaaactctttcagggtccatgttgtcccttgagaggatcgttcctgctgctggttgctcccacactgcaggggccttagcttttcatccacagctgagcccccatggactcaatgtagctttggcacagaaacaaggggaattgtaggtgctgtcccttgctggcttcccagactagtcatctccatgctggaggatagacattcttagctcacatttcaatgtattcatttctgcattcatctgtgaacagagtctgtcctttgcatccaggggaggaggcagatggaggtctgagtcactggagataaaccagcatattctgagagcaggcaggaaggagcaatgacttccaagcagtgggctcccaaaggcctcacagagacatgggcagggctggagagtagaggtgtattttaggagatgaagctgaacagctgggttgggttgagaaggcgtgggccttgaatgctttatggagggcagagtgatgtgcacaggctgtgggttagggagatgatgaggctggattgggcatgagaagcccagtttgggatgaggagccattgagccattcaggcaagacagccctccctccttcacgggcttaatcctgcaagattctgtcaaatcctggcttctcccagcaggacacaccttggagacatcctgatggcacttccccagagtggcatggcccacataggagtttgctgttggctctaggactcttgaagaaagtgcacaagatcaaaacaggtgacagtgaagtggtttcggccctgccaatctgatatcgtgtacgtatgagagtggtcagcattttaccactggtaacaagttccttgctgttcattcattctgctagttttttgcgatttcccgctgtgtgccaggcatagtcctccactgatggcaatgccagacagcagcgtggcagagggctctggcccaggaagcaccctgcaccagcacctagcgtccagggagccttggcctcctggcgagcctgcctttccttggagtcctccaggtgtccccccaactatacaggcacatgtccccattcttttagaccccaatctttcccaagctgacatgtcaccaggtgacatagtggttcagtggccatgacacaaggaaagccccttcaccctataaaatccccagcctggatggccactccactccacaaagtgacaggcagattcccataagcgttgcgtagaaattccatgtcacaggcaccttggacagtagccatagaagtgtttctgttccagagtaacattttatttattacttatttatttatttatttattgacagagtctctctctgtccgccaggctggagtgcagtggcttgatcccagctcactgcaacctccgcctcctgggttcaagcaattctcctgcctcagcctcccaaatagcggggattacaggcacccaccacctgtaatcccagctatttggagatcaaatgctcagctaatttgatatttttagtagagacaaggtttcaccatgtggacaggctggtcttgaactcctgatgtcaggtgatccgcctgcctcggcctcccaaagtgctggaattacaggcacgagccaccgcacccggcccagactaacattttttttttttttttttttgagacagagtctccctctgtcacccaggctggagtgcagtggctcaatctcggctcactgcaagctccgcctcccaggttcacgccattctcctgcctcagcctcctgagtagctgtgactacaggtgccaccaccacgcctggataattttttgtatttttaggagagacggggtttcaccatgttagccaggatggtctccatctcctgacctcgtgatccgcccgcctcggcctcccaaagtgctgggattacaggcgtgagccaccgtgcccaagcctgactaacattttaataactacgcttaggcaaaatagtaaaaggacaaagtctcccacttactctctttctggggactgactggcttgggcgctggctgaaacccagtgtcttcactccctgtgtgacctcgggcaggccccttccccctcagttagctgcaggcaggtgttggactagatctgtggttttctgacctgggttccacaaagcaagctcagggactgtcctgcggatgaagaagaccagcagcaaagcaggcagagctctgcctcctggggcaaaacatttgcaattaatgacactgaaaagaatgtgcaaatccccagtctcctctccttcccgtcagtgtccagcccagccctttgaactgagtggtaagctcattctggaaccagagacaaagcctaaacagccactggaaggtctgggacccacatcagcccccacatctgccctgccttctcatcgaagacatattttgtgcgcatgcctggtgaaaacttcttaatgacagctctgcccatccctgtaactggcttctacccaggcatatcccttctcctctgcttcacctaccagacctcttcaccaaagtgtgccagcactaaaagaaacatttaaaatcaaaattaggtgaagcaccaccaccattatgagattctatagtgtcttaatgttcacccagttgagattctctgctaaattagacatggaaaattggaattgattgctcgcatgtggggcttaattaaacgctctattttttctccctggtaa

SEQ ID NO: 10443 - DNA, 2199 bp, Homo sapiens
  ENST00000568181
gtcccttccctgggcaccaagagatgggctccccttgcctggcagagaaacagctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccaggtgagcggcctctgatggcattcacggctccatcccgcagggtgcctgggcggagatgtcttttaggggcccaagaaaatgtcttcagatcttaaaataagaagaaaaaaatgaatattatccaacatgggttatattcattattaggccatcagtcataaaagataattttccatcttttttttttttattggagtcctgcaaaggcaaaagtgcctaaggctcaccgtgaaaatcattacgtggccctcagccatgcgtggactcagtgggccacacagacacagtgtcacctctcccagctctcccgagtctgtgactacaggcaaatcacgccacctcctctctgagcctgtctcccactccgtgaaatgggtaacatcacctcgaaggtttactcacccagtgaactcaacatgtgtttactgaacaccactctgtgctaagccctagagcaggtcaaaaacataaaatccctgccttcttgagctaacattctcctgggcatccccactccattttcagatgaggaaactgaggcatgggccatttattttcctcggagctccacagtaaggatgccaatgatgcaaaggtccccggcctcagtttccctgcagtgctcagtgtctgggccagtctcactggatgggaaactcacagatgagctgatctgtaagtcactctgccccaggaggccagagtaaaaagtgctgcttgcccacaccttcgtcccctttgcagggagttacaggagaccccgagacaccctccctccactcgggagccagatggtctgagaagtgaaataagaacctagcatttggttgagagggttattggaaagcttcaaacagagaattagattgtttcctgatttaaaaaatcactcctctccagcaccgagctcccccagggctgcccatcatcttaatgtttggagcttgccttgtaatcaacagagagagaaactaaacacatacgtaagatggtgcttgctctatttggctcctaacagttgccagcccacctaagttctcttcgcttaaagatatgtcccagggcaagacaacaggatcagagaacttgccagatagaaaagacttaaatggagaaccagcccatgcctcacagacagtaggatcccagtaaatatgggttgaataaaatgtgtcttgtccaacctacaaaagtttggccctaaaaaaacccacaaaatatttggacctttaaacagcttgttttcccatggagaagatgacaatgccaatcataggcattttttcattctacagcataaaaacatgagatttaagagcctg

SEQ ID NO: 10444 - DNA, 3445 bp, Homo sapiens
  ENST00000367007
agggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggagggtctcactctgttgcccaggctggtctcaaactcctgacctcaagtgatccatctgcctcagcctcccaaaagtgctgggattacaggtgtgagccaccacacacaacctaaagcattctgtctgatctcttcaatgttgcaaaacatctctgtgaatatgattcttgtaattagtcaaaaggacgagtaatatagagctaagtaatgaatgccatgttttgggtgccaaatggagttcaatgattttaaaaagagggttttttgttttaaaataaaaccatttccctgagaaagcctcagagaggctttctcaaaatgtgctgaggccagtagtatcatactttggcttctcatgttgtccacactgaagggaaccctattgtatggatatattctgatacatctgctaaaaaccaaactcattatattacggttaatttactatgtttagtcaatggttatattattattctaaataagcaagtgagcagtctcactttctgtcaggagaagccaccccctcccctacctaaactgctattctcccagtatatag

SEQ ID NO: 10445 - DNA, 3479 bp, Homo sapiens
  ENST00000638498
agagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggagggtctcactctgttgcccaggctggtctcaaactcctgacctcaagtgatccatctgcctcagcctcccaaaagtgctgggattacaggtgtgagccaccacacacaacctaaagcattctgtctgatctcttcaatgttgcaaaacatctctgtgaatatgattcttgtaattagtcaaaaggacgagtaatatagagctaagtaatgaatgccatgttttgggtgccaaatggagttcaatgattttaaaaagagggttttttgttttaaaataaaaccatttccctgagaaagcctcagagaggctttctcaaaatgtgctgaggccagtagtatcatactttggcttctcatgttgtccacactgaagggaaccctattgtatggatatattctgatacatctgctaaaaaccaaactcattatattacggttaatttactatgtttagtcaatggttatattattattctaaataagcaagtgagcagtctcactttctgtcaggagaagccaccccctcccctacctaaactgctattctccc

SEQ ID NO: 10446 - DNA, 3831 bp, Homo sapiens
  ENST00000640710
actgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaaggggtctcactctgttgcccaggctggtctcaaactcctgacctcaagtgatccatctgcctcagcctcccaaaagtgctgggattacaggtgtgagccaccacacacaacctaaagcattctgtctgatctcttcaatgttgcaaaacatctctgtgaatatgattcttgtaattagtcaaaaggacgagtaatatagagctaagtaatgaatgccatgttttgggtgccaaatggagttcaatgattttaaaaagagggttttttgttttaaaataaaaccatttccctgagaaagcctcagagaggctttctcaaaatgtgctgaggccagtagtatcatactttggcttctcatgttgtccacactgaagggaaccctattgtatggatatattctgatacatctgctaaaaaccaaactcattatattacggttaatttactatgtttagtcaatggttatattattattctaaataa

SEQ ID NO: 10447 - DNA, 8172 bp, Homo sapiens
  ENST00000271751
ggcggctgccgctagccgaggccggcgcgagtgcactgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggactgcagtgggccaaggacttcccggcatccccgtccttgtacagcccgtgtctgacgtcaccatgttttcctgtagttgtcatttataactagctcgggacaagcagagcttgagggacaggagggtagagctcagaaactttctgtctcatggttaaggccagaaaagcagctgcaggtgtggtgcatgcctcccatagacacttgaagctgggaatcctcaggtctccttccccaaaggaggtgaggcaagggtaagagctggagaggggcccttaagatccaggggttctctgcggtgcaacccatagcctgctcctctgggacagttgacagggagggctctggagtgcctggctgagcctctggccctgctccatgctgctggcctcacacacaggctcccttgcttctgttccttcttggcctcttcccaagtgtccccatggcattcctcagggtatggagcatcggcaggaagggtcatgagcccagagttgctttattaacaaagcagacacacagacacacacaacctcagaactgtagcaagtgctatgtttatactttgattctcattgggattgccctgcagacctttgtattttgttcaccgcacggggtcattataggcacttgggagccatgctgggccttattttaaagccagtctctctatttcctattaaagtcagtaggatttcaagagaaaatggaaaaagactgcaggatcatgattgtactctcttcaggagctggaaagagaatgaagcagtgagtttccagctctctgtaaggtgatggagagaagtggccttggagctgtggctcccagtgatggtcacagaactgcgtatgggccatccaagcccctatgccacgatgctcggggacacttcactgcctcatggtcacctaagtcaggttattcatgtgcttgggcttctctcaatggcatctgagaaaggaaaggagtgaagtctcttccaggcacagtggagctggccggggcatatgccctagagagaggtgtcaggaccccaaatactgacacgcaaggttagaagttcagctctgaaaagtcaacttggagggaatggaattaggagtacaggtgacagcatggacttatccagggagcttacctttgcctgtgttagacggtgaccccattcctggtacctctgccctaccaaagatattcagtgtttctgagagcctccggtctgagactgcccaccaccccaccccaccccacctccttagtcctgcccagtgctcacggcgagtcccagggctgggccctcggttgtctgtgcaaggcagggctgacctctcctggttcgcagggttggcacagatggccctgggaagacaaggcctgcgagctcaagggagagtcctgctccatgagccctaacctcatatgtagcttctcacatcaggcttacaggggctgcccctggcttctccaggttgcgacataattagatttagcctcagatggcggcatacaagtaagaggaagtctaatttcctaaggccgagtcacaactatctgtgactttgaataaagctgtgaggccttcagcctctttcacttgagaagctgccaaccagtccttgggtaagaggccgtaaaatatctggaatcccatctgttggctgccccctaacattctagtctgccatttcttaaacatgctcctcaacctgcttctgaagtttaggacccaccacttttaaggcagggcaggcctctaatcacccccaaaacccagcctcagaagaacctgccactggagacacttttttgcctctcagctctccagggacttgatgacaggcttcttgtctggcacccaacggtcaatgtcaagaggccctgccatttccctccagctctgcctgagggagacggatgtccgtgaaatttctcagacctctgggtatgaggggcaaagatggtataaggctttgaagtccagacatgttcttggggggaatgtagctttaggaatgcactcgtgaatcagcgcaaactgggctcatgactggaagccagctcctgcggcaggaatctgttcatcttgggtcacaggtgcacgtgtgggtgcatgggctttattctcctgtaatcctccctaggatttgagggattttttgctgtaattgttttctttgaaaaaacattgtgtaaatgagccaaacctttctcccttccttttcgcaccatgaacttgaccgcaggctgctttgtgctgactgccttcccatgccaggatgccactctgggttcccgagccaggaccatgtgcctcagataccagtgacctgagccttccagtataaaccattatctggtggctggagagagattagggaaacaaaaagttactaggtatgggacagaacatttagacttcagaaaaagtatgccaagagagaacagatttgcccaggatgtatgtttttcctctttgaggagtcggggcatgatatgtggcaccattatctagtaagtgctggttatttgatttctactaaattctttactttgaatgtcattcatattgaagctccatttcccagagaatatcctgacaggctgctttgaagagggtaggtcctgtccctgtcacttggctgctggttgaacgtgctcctcccggctgatggaggggtgggtttaaggttaactctaagaactaagatggtcaatgaggtggtgtttgttcttggtgggggggcattgactccagcaatgggcgctgccatcccatatacttacaaagggctcctccactggacatgacaagatagccaaaggacggaaacagagacgaccatttggttgagaaaccaaattgtctagtgtacaattaatgcaactcattgcattcatgaatgcaactcattgcattaatgcaatgctacattatgctaataaggttacaacattaatgctacaggatagcccaagtatttaaaaagctgagcccatttagcagccttccagcaaacttttggaaatgcatttcttacttgatttcttcttgttatccaatccctggggactgttttacccacaacctcttcgatccagtgtgctgctgttggccaaacatcagcccctttcctggaatcctcctctttcaaaagtggggagggctgggcaggggtaaaaatgtactataccaccccatcccattcagcaagcttcctctccaaatccttaaatggaaggtagaagtattatgccaactgtcaagctctttgtccaggcccttgtggggactaaatgaactctttaggaatactaggtataggaagactaggtataggaagattctcatttccccttgttgcactgaccactatgtctcccatgcatactctgggaaattttaggagccctggtggagatacacgttgctgatgtgcatttgattaataggttttactatgtcttgcaataaagacgtttagccttaagacccttgaatggaactccagctgtgatagagctgccaatgccccttcctctctcctcccttatcacctagtgttgcttaaagaggaggccattgagggcacacttgatgccccagacagcctccctctgttgctaaatcattgttattgctctatatactgccttctcactcgcttcaattaaaaattaccttcaccagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggcccttccattgatgatattcccttctcaacatttttaaacaagcacaaatgatatttgtaaaaaaaaaaagttttatttattatggtaataaactattttatacatga

SEQ ID NO: 10448 - DNA, 8075 bp, Homo sapiens
  ENST00000639952
ccgaggccggcgcgagtgcactgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggactgcagtgggccaaggacttcccggcatccccgtccttgtacagcccgtgtctgacgtcaccatgttttcctgtagttgtcatttataactagctcgggacaagcagagcttgagggacaggagggtagagctcagaaactttctgtctcatggttaaggccagaaaagcagctgcaggtgtggtgcatgcctcccatagacacttgaagctgggaatcctcaggtctccttccccaaaggaggtgaggcaagggtaagagctggagaggggcccttaagatccaggggttctctgcggtgcaacccatagcctgctcctctgggacagttgacagggagggctctggagtgcctggctgagcctctggccctgctccatgctgctggcctcacacacaggctcccttgcttctgttccttcttggcctcttcccaagtgtccccatggcattcctcagggtatggagcatcggcaggaagggtcatgagcccagagttgctttattaacaaagcagacacacagacacacacaacctcagaactgtagcaagtgctatgtttatactttgattctcattgggattgccctgcagacctttgtattttgttcaccgcacggggtcattataggcacttgggagccatgctgggccttattttaaagccagtctctctatttcctattaaagtcagtaggatttcaagagaaaatggaaaaagactgcaggatcatgattgtactctcttcaggagctggaaagagaatgaagcagtgagtttccagctctctgtaaggtgatggagagaagtggccttggagctgtggctcccagtgatggtcacagaactgcgtatgggccatccaagcccctatgccacgatgctcggggacacttcactgcctcatggtcacctaagtcaggttattcatgtgcttgggcttctctcaatggcatctgagaaaggaaaggagtgaagtctcttccaggcacagtggagctggccggggcatatgccctagagagaggtgtcaggaccccaaatactgacacgcaaggttagaagttcagctctgaaaagtcaacttggagggaatggaattaggagtacaggtgacagcatggacttatccagggagcttacctttgcctgtgttagacggtgaccccattcctggtacctctgccctaccaaagatattcagtgtttctgagagcctccggtctgagactgcccaccaccccaccccaccccacctccttagtcctgcccagtgctcacggcgagtcccagggctgggccctcggttgtctgtgcaaggcagggctgacctctcctggttcgcagggttggcacagatggccctgggaagacaaggcctgcgagctcaagggagagtcctgctccatgagccctaacctcatatgtagcttctcacatcaggcttacaggggctgcccctggcttctccaggttgcgacataattagatttagcctcagatggcggcatacaagtaagaggaagtctaatttcctaaggccgagtcacaactatctgtgactttgaataaagctgtgaggccttcagcctctttcacttgagaagctgccaaccagtccttgggtaagaggccgtaaaatatctggaatcccatctgttggctgccccctaacattctagtctgccatttcttaaacatgctcctcaacctgcttctgaagtttaggacccaccacttttaaggcagggcaggcctctaatcacccccaaaacccagcctcagaagaacctgccactggagacacttttttgcctctcagctctccagggacttgatgacaggcttcttgtctggcacccaacggtcaatgtcaagaggccctgccatttccctccagctctgcctgagggagacggatgtccgtgaaatttctcagacctctgggtatgaggggcaaagatggtataaggctttgaagtccagacatgttcttggggggaatgtagctttaggaatgcactcgtgaatcagcgcaaactgggctcatgactggaagccagctcctgcggcaggaatctgttcatcttgggtcacaggtgcacgtgtgggtgcatgggctttattctcctgtaatcctccctaggatttgagggattttttgctgtaattgttttctttgaaaaaacattgtgtaaatgagccaaacctttctcccttccttttcgcaccatgaacttgaccgcaggctgctttgtgctgactgccttcccatgccaggatgccactctgggttcccgagccaggaccatgtgcctcagataccagtgacctgagccttccagtataaaccattatctggtggctggagagagattagggaaacaaaaagttactaggtatgggacagaacatttagacttcagaaaaagtatgccaagagagaacagatttgcccaggatgtatgtttttcctctttgaggagtcggggcatgatatgtggcaccattatctagtaagtgctggttatttgatttctactaaattctttactttgaatgtcattcatattgaagctccatttcccagagaatatcctgacaggctgctttgaagagggtaggtcctgtccctgtcacttggctgctggttgaacgtgctcctcccggctgatggaggggtgggtttaaggttaactctaagaactaagatggtcaatgaggtggtgtttgttcttggtgggggggcattgactccagcaatgggcgctgccatcccatatacttacaaagggctcctccactggacatgacaagatagccaaaggacggaaacagagacgaccatttggttgagaaaccaaattgtctagtgtacaattaatgcaactcattgcattcatgaatgcaactcattgcattaatgcaatgctacattatgctaataaggttacaacattaatgctacaggatagcccaagtatttaaaaagctgagcccatttagcagccttccagcaaacttttggaaatgcatttcttacttgatttcttcttgttatccaatccctggggactgttttacccacaacctcttcgatccagtgtgctgctgttggccaaacatcagcccctttcctggaatcctcctctttcaaaagtggggagggctgggcaggggtaaaaatgtactataccaccccatcccattcagcaagcttcctctccaaatccttaaatggaaggtagaagtattatgccaactgtcaagctctttgtccaggcccttgtggggactaaatgaactctttaggaatactaggtataggaagactaggtataggaagattctcatttccccttgttgcactgaccactatgtctcccatgcatactctgggaaattttaggagccctggtggagatacacgttgctgatgtgcatttgattaataggttttactatgtcttgcaataaagacgtttagccttaagacccttgaatggaactccagctgtgatagagctgccaatgccccttcctctctcctcccttatcacctagtgttgcttaaagaggaggccattgagggcacacttgatgccccagacagcctccctctgttgctaaatcattgttattgctctatatactgccttctcactcgcttcaattaaaaattaccttcaccagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggcccttccattgatgatattcccttctcaacatttttaaacaagcacaaatgatatttgtaaaaaaaaaaagttttatttattatggtaataaactattttatacatg

SEQ ID NO: 10449 - DNA, 4173 bp, Homo sapiens
  ENST00000640528
gggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaaggctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggcccttccattgatgatattcccttctcaacatttttaaacaagcacaaatgatatttgtaaaaaaaaaaagttttatttattatggtaataaac

SEQ ID NO: 10450 - DNA, 4592 bp, Homo sapiens
  ENST00000638960
cgcgagtgcactgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggactgcagtgggccaaggacttcccggcatccccgtccttgtacagcccgtgtctgacgtcaccatgttttcctgtagttgtcatttataactagctcgggacaagcagagcttgagggacaggagggtagagctcagaaactttctgtctcatggttaaggccagaaaagcagctgcaggtgtggtgcatgcctcccatagacacttgaagctgggaatcctcaggtctccttccccaaaggagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggcccttccattgatgatattcccttctcaacatttttaaacaagcacaaatgatatttgtaaaaaaaaaaagttttatttattatgg

SEQ ID NO: 10451 - DNA, 1214 bp, Homo sapiens
  ENST00000640625
gcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggccct

SEQ ID NO: 10452 - DNA, 3740 bp, Homo sapiens
  ENST00000638357
cccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctagattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggactgcagtgggccaaggacttcccggcatccccgtccttgtacagcccgtgtctgacgtcaccatgttttcctgtagttgtcatttataactagctcgggacaagcagagcttgagggacaggagggtagagctcagaaactttctgtctcatggttaaggccagaaaagcagctgcaggtgtggtgcatgcctcccatagacacttgaagctgggaatcctcaggtctccttccccaaaggaggtgaggcaagggtaagagctggagaggggcccttaagatccaggggttctctgcggtgcaacccatagcctgctcctctgggacagttgacagggagggctctggagtgcctggctgagcctctggccctgctccatgctgctggcctcacacacaggctcccttgcttctgttccttcttggcctcttcccaagtgtccccatggcattcctcagggtatggagcatcggcaggaagggtcatgagcccagagttgctttattaacaaagcagacacacagacacacacaacctcagaactgtagcaagtgctatgtttatactttgattctcattgggattgccctgcagacctttgtattttgttcaccgcacggggtcattataggcacttgggagccatgctgggccttattttaaagccagtctctctatttcctattaaagtcagtaggatttcaagagaaaatggaaaaagactgcaggatcatgattgtactctcttcaggagctggaaagagaatgaagcagtgagtttccagctctctgtaaggtgatggagagaagtggccttggagctgtggctcccagtgatggtcacagaactgcgtatgggccatccaagcccctatgccacgatgctcggggacacttcactgcctcatggtcacctaagtcaggttattcatgtgcttgggcttctctcaatggcatctgagaaaggaaaggagtgaagtctcttccaggcacagtggagctggccggggcatatgccctagagagaggtgtcaggaccccaaatactgacacgcaaggttagaagttcagctctgaaaagtcaacttggagggaatggaattaggagtacaggtgacagcatggacttatccagggagcttacctttgcctgtgttagacggtgaccccattcctggtacctctgccctaccaaagatattcagtgtttctgaga

SEQ ID NO: 10453 - DNA, 3027 bp, Homo sapiens
  ENST00000640243
agccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggac

SEQ ID NO: 10454 - DNA, 1818 bp, Homo sapiens
  ENST00000640044
atgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacacacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctga

SEQ ID NO: 10455 - DNA, 1365 bp, Homo sapiens
  ENST00000640566
atgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacagaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctga

SEQ ID NO: 10456 - DNA, 1817 bp, Homo sapiens
  ENST00000640522
gcactgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctgg

SEQ ID NO: 10457 - DNA, 2401 bp, Homo sapiens
  ENST00000639754
gcactgcgaggcgggccgcagggagggaggcgcgaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctgtaagtatgacagtgctggggtggggttggccatctcttctgttagctggaaacagggaaatggctacagtgccagcaggatcaggagaataataacttaaaacaaggaagagtttttttaagactaggcttacagttaccctgataattaaagcagtatatgcttactgcaaaaaaatttagaaaatacaaaagagtgcaaagtagaaagtaaagactatccataattctgcttttcagagataactactaatactgttggtgtcttctcttacagactattttctttgcatatctgaatacatatagatttttataaacttaaaatgagatcttgctgcatacgcactttagtaaactactcatagaacagtgaattatggaagtcttttcatgtcaatttttttctttttaataaaaattgtatatatttaaagtatgaaatgagattttgatatagtgaaatgattatgacagcaaagcaaattaacatatccattcctttacatcattaccttttttttggtgaaagcacttgaaatctgctctctcagcaaatttcctgtaggcattacagtattattaactatagccgtcatgctacatgtcctacatgtcaatttgaacatagctgtagcttggcatatagtctaatgtagtatgagaaaaagaatgtatgaaaaatgaatgcaaaacatctcattaattgtattttatattgattatatattgaaat

SEQ ID NO: 10458 - DNA, 1948 bp, Homo sapiens
  ENST00000640890
ggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctgtaagtatgacagtgctggggtggggttggccatctcttctgttagctggaaacagggaaatggctacagtgccagcaggatcaggagaataataacttaaaacaaggaagagtttttttaagactaggcttacagttaccctgataattaaagcagtatatgcttactgcaaaaaaatttagaaaatacaaaagagtgcaaagtagaaagtaaagactatccataattctgcttttcagagataactactaatactgttggtgtcttctcttacagactattttctttgcatatctgaatacatatagatttttataaacttaaaatgagatcttgctgcatacgcactttagtaaactactcatagaacagtgaattatggaagtcttttcatgtcaatttttttctttttaataaaaattgtatatatttaaagtatgaaatgagattttgatatagtgaaa

SEQ ID NO: 10459 - DNA, 711 bp, Homo sapiens
  ENST00000639385
atcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattc

SEQ ID NO: 10460 - DNA, 614 bp, Homo sapiens
  ENST00000624583
tctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagagatggagtcttggtctgtcacccaggctggagcacagtggcgtgatcttggctcagtgcaacctctgcctcccaggttcaagggattctcctgcctcagcctcctgagtagccagaactacaggcatgcgctgctacaccgggctaatttttgtatttttagtagagaagggttttcattatgttagccagggtggtctcgaactcccgacttcaagtgatctgctcaccttggcctctcaaagtgctaggattacaggtgtgagccactgcaccgggccgaaccatctcttctttatcgccccctttcctctctatctctccctccactaccatctcctctttagc

SEQ ID NO: 10461 - DNA, 3445 bp, Homo sapiens; identical to SEQ ID NO: 10444
  ENST00000639262

SEQ ID NO: 10462 - DNA, 3479 bp, Homo sapiens; identical to SEQ ID NO: 10445
  ENST00000639694

SEQ ID NO: 10463 - DNA, 3831 bp, Homo sapiens; identical to SEQ ID NO: 10446
  ENST00000639420

SEQ ID NO: 10464 - DNA, 8172 bp, Homo sapiens; identical to SEQ ID NO: 10447
  ENST00000638907

SEQ ID NO: 10465 - DNA, 8075 bp, Homo sapiens; identical to SEQ ID NO: 10448
  ENST00000638293

SEQ ID NO: 10466 - DNA, 4173 bp, Homo sapiens; identical to SEQ ID NO: 10449
  ENST00000640402

SEQ ID NO: 10467 - DNA, 4592 bp, Homo sapiens; identical to SEQ ID NO: 10450
  ENST00000639355

SEQ ID NO: 10468 - DNA, 1214 bp, Homo sapiens; identical to SEQ ID NO: 10451
  ENST00000638734

SEQ ID NO: 10469 - DNA, 3740 bp, Homo sapiens; identical to SEQ ID NO: 10452
  ENST00000639736

SEQ ID NO: 10470 - DNA, 3027 bp, Homo sapiens; identical to SEQ ID NO: 10453
  ENST00000640738

SEQ ID NO: 10471 - DNA, 1818 bp, Homo sapiens; identical to SEQ ID NO: 10454
  ENST00000640013

SEQ ID NO: 10472 - DNA, 1365 bp, Homo sapiens; identical to SEQ ID NO: 10455
  ENST00000639281

SEQ ID NO: 10473 - DNA, 1817 bp, Homo sapiens; identical to SEQ ID NO: 10456
  ENST00000640966

SEQ ID NO: 10474 - DNA, 2401 bp, Homo sapiens; identical to SEQ ID NO: 10457
  ENST00000639471

SEQ ID NO: 10475 - DNA, 1948 bp, Homo sapiens; identical to SEQ ID NO: 10458
  ENST00000639652

SEQ ID NO: 10476 - DNA, 711 bp, Homo sapiens; identical to SEQ ID NO: 10459
  ENST00000640802

SEQ ID NO: 10477 - DNA, 614 bp, Homo sapiens; identical to SEQ ID NO: 10460
  ENST00000635558

SEQ ID NO: 10478 - DNA, 11290 bp, Homo sapiens
  ENST00000322893
gttcccgagccccgtgtgcggcaccgccacagtctgggcagcggcggccgggggagcgctactaccatgaactgcctggtcctcctccccagagctgctcatccgggtcgggctggagacacagtcaggggaccccgtcgccgccgccgcgccccctcttctttcggctcaatcttctcttccaccttttcctcctcttcctccaccttctttgcctgcatccccccctcccccgccgcggatcctggccgctgctctccagacccaggatgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggatatttttagtgtctcaaggcctgaatcacctgaatctgacaaagatgaaatccacttttaatatatatacatatatatttgttaatatattaaaacagtatatacatatgtgtgtatatacagtatatacatatatatattttcacttgctttcaagatgatgaccacacatggattttgatatgtaaatattgcatgtccagctggattctggcctgccaaagaagatgatgattaaaaacatagatattgcttgtatattatgcagttgactgcatgcacactttacatttatttataatctctattctataataaaagagtatgatttttgttacccaaggcaatgtaatatttgaagaatcagggtccaacctgccaatgttgccatgacaaatttgatctcaggctgagtatgtatatcgagctatcattttctcactgttctgttaagttaaaagtatagattaatgccaaggaagagttcagtcttttaaactattagtaccatgttatgatctctttccataggatatttttctgtaacttagtgttaggttcttttcccctacaggcagtgtttgctccatttaaatgactgtttagttgcctaagtcagataagagtgtgggatattgaaaacttattgctatgggttttgtgcatgaattacatttttgatcaactatacctctcgttttttaacattatacttagatagtaatcattagctcttatgtaaggaaatccctactccctccttcttggagaacagctgccatcttgtaagctgacattatcaacatcataaatactaaactattaatatagagtatgttattatagaaacactgcaccacagggtataagggccttttgacaattcatgtaagagatgctgaatttccaaagctgataaatgctctaaatttgtatttccaaaacatgttcaagagtgacattgaaaggcttgttagcaaagaaacatacaaaaaataaagcatttaagtaatcatatcaaaatgctaactattatggtataaaataaaaaagaatgtaaacagatagataaatttttgtggcatgtatataacttagaaagaatgaaacactggtacggattgttgacacatgaatcctagtgtttgtagtgataacacatgaaatgtggtaaaacaaacaaaccaaccaaccaagaagtagacattaagttgctcgactcagataactgcttttctatcattttattgtggttatagttttttaaagctttttgcacacagttctactgctggacttctgctgagttgattcaataagctattgtggctcaggcaggtccatttgtgaaagggggatactaaagactgaattttagtcttttgaattcaaatcctctttgtagaaagtgcctattatcaagtttttaaaaaaagtcacaaagagttgtcctgtatatagctagtcccttaaatgataaggattgagaataaaatacacattcacttgtaagaacccaggagaacttatttcttttgactaaactgtattttaggaagtcgttcagggaagcatacttttcagtcagtgcatgcacagcatttaatatggggagcaggggagttagtgtttgcatgaagttgaaaaaaatgtgtgagtaatttatatattacgggaccatctgtacatatatgttaacaatatgcaaaagatgatggcaaaatcgaaggagatatcttgatctattatacccatttgtatgagcttttctatctcccagtattcccaaccaaagccactagaactgaaagacatgttatcacattcagacttgagaagtgcaaaacagtgatttataaaaacagttgctattttagaatttctattgaacttcacatgcccacaagatgtgcctctttaatctaggagtctcaaaacatatgagccatgggctccattttcctttctttatgcgtataacttccattaaccataatggaagttttcaggggaacacgtctccatgtaatgctacaatatctacctaccacaaacacaagaaaatgaaataattatggagtaaagaatcagccttgaaattggaattttgttgctttcatggtgaggatgatatctttttcgtgacctctgacatttattgaatttcagggtatttttctatttgtttaagtcaagtttggcttaagcttttaaaggtgaatgtgtggttaaaataagaatctgattatagaagttgttagtttaactttagccagtgcttcaaaactaactattggtgtaaagctataaaagaatgactgtgaacaacatgatgatttgaagttctaattcatggctttgcatattagtggtgcaaatatttactgtgttctgacattgacgtagagtttcacctaatcgacctacaatgttattgttcatatatgtgagaaacataatggttttgaattactccagattgttaggaaggagggaaagtatcaattgtttaattatggtgcagttatcatagtgtcttttcagccatctctgttctctgtgtgcatgatatgaagaggtgctgaatgcaccctgctgttttcagcaggaatgcatgttttcagcaaacattgtatatagagtagtcttttaggttcccagattccacaaatcttagcagttgaatttactcagatttgaatgaagggagaatatttgctttaatacatgcaataatgataaaatcatgttctatgttgcctcaactagcacatagacagtagatgctcttttgaggaccagataactgcatgttttattcctacactgtatagatgctcttggtgcatccagaataaaaattttaatattatatttctaaataatatattaataggagtaaatggatatgtattagaaatccaaacattttccaaagcaatttacacaccttcaatatttttctatgatgttattaataggtaagatcagatgctgtatcctcgacaggtggttgtaacaaaatagcaaaagtcaaattagaatggaaatgtgagtgatgtatcataatggcaggttttatcagtctgtatcaggatattgttgcactaaatgtgatctagcagatggaagagattatgataaaaagcaaataggcacacaaaagccagatgacaataccaaagctatatgaatggtactgaaaatggttcaggcacagtggttgaattgaatgacgtggttgaatacaggcccatgcttcattgttaaaatggaaaatttttatgacactagttgcatcttgcattaagtataggactaaaaatgtcctaagtattttttacaaacaactttatgtatatcagagaaaaaaatggaaaatctggggtttgaaattgctctagaaaaaatgtgtacttctgttgtactcaacactttaataggaaaattagttgtgaccgctaactaaagtaccattatcaaaattaaccttattggagcccaaatgaaaatcacattttcccttctgtttaaggagattttgttcaccctgtgatatctggtccatttgatatcttattttaaatagctaaagtcatttggaattttttttaatattagccttcagagcagtgactgttttgaagtgtgcagtggcagatatttgtgaaattattcatcatatttctaatgaattccactatcttgtataatttttatcttttaagcaattttctatgagtttgttttccaaaattccatgtaggtaatgagaacatttatctagaatgtgcatatcatacatggataactttcaaatatgaatattttataatcatgtgaatgttgtgctataattttttctattaggtgtaaaagtatttctcttctcatcttaatggaaagggggaaaagacaaaaacagtcttttggaaaacaccttaagtcttagtatctgagctttgtcttgtgttctgaatttagctttaccacaaactagaagtgtaattatgggcaagttaacctttcctagtgtaccaaatggtaccatttccccgccaataaataagaaaacaaagataacagctgttgcttccttatatcaacatgctattggtcaatgaaaaaattatctttcttgcaggtgaaaatcacattatgacaagtgatcactttttcattctttcatagaagagtatccacgatgtactctctatcaaaatattcttctagattttagaagagatttcagggattgacggtgatgtgatttttatctaaatattcttttaggttttagaagagatttatctggtcagaggttaatggagagaggcatagtttgctagtggcaggtaagcataaaacttcatacttatgtgggaatttagaactacaaatcaaataaacgtggaaagaatgaagctcctttgacagaagagagagagaagagaaagataggtaaattttgtgatttttcttatttctacttaatcatactgcttggcagaaattctcaattttgtgaaaaaattggtaagtggccaaggtatagagtagttcaccaatgtatctatgtaacaaaactgaatgtgtaccccttaaatttatacaaataaaaactagagtagttcatccttcaactttttatattaaaataatcatgacctgttcaagatatatgattccacatgggcagacactcttataacaaaattcttaactatgtgctatgtgttgtaagttttggcctatattctgacttgagattttctatcacttcatttgtaggataagacccctgtgtttgcattctttatgagggtcaggaccactgaggatttggactgggaactagaaagatgatgaaggcaagggttgagaaaagactgattagaatctatctgcttctttactcttaggcttagaagttaaataagttaactaagcttatatttaccaaggtctcactatgataagcattttatttaggttatcaaatttaattcttgcagcaaccccatgaaggtataggttaaggaacttgtccaggatggcatacttgttacatggtaaagttgagtttctaacacaggcagtcagaccttagggagaaacctttattttgtagaatactgacattacaagaactatctagttcaaccatctagtctaggtttttccagacacatacttttaaagatttcttaaaataattcttaaaaattgcactcgataatgtgaatgtaaatgtttggtttttcttgataggtcagagtcaatgacagagtttgaaatcatactgtcttaagcaaaaggtgccctgtcccaacagtggaattttcctttacttctcctaacagttgaaagacatcggccaaagtaaactgtcaaatgtggtatgtttgatatatggtcactggtatcaacattttcttttccagttgaattttaacctaaagaggtaatgcctaatggttaaggaaagcaagagtcattcaggattttttttctataatttctttttctttttaatagtgggatttggatgagactccagaatttatttttaaaatttattttttgactcattgggttttaagtagattattcagatatttttattgattgcactgatgttggcttcttggccaaaccactattaaatacattatccaaatgaactatttctgtttagaatggcaacttgtatccttatttccaaaattaatgagctcacagtatgtatatttacttcagagagtttcaataattttctctaatgaaaaaatgttaattttctgaatgtgatttatttgttctaccctttgagatttctaaagcaagtgtcttgagataaggagaaaaaaacaagatattacaacactacatgctggaatcttcagcccaaaccatcttgttttcacttggctaataactgagccagaggtaatcatagaaaggaagaatcctacttttaaaataatgactgtgaaggaccccactgacaccatccaaagctttttatagtcagctcacttccatcctggcttttacattaccactgcatgattatttaaatgaggtcatgtcttgtactacttgtaaaggcacttggtcaaagaagagtaaaccaaaaagtgcagcttatgaccagagttataactgaggaaaaaggagtgtggagaagggacagcagttgcttccttttaatgagttttctgtatgtggtgccttttaaatagcttttgtttatttgtttttaagatgacacattgtcattaaggttttaacaaaaacctttggaagcagtttgaaagcttgtcaaatgctggggccttctttagaaataagtgttctcccaccaaccaatgagtttagaacctctggttctgacctacaaacccaatcccctaagcacttggctggttgggctgcattttgatgggaggaaacaaaaagatctgatcactctctctcattcatgcggaatcactgactgttgaatgaccaaagcagtcaaagccaaaatattcaccttgaagcttcaataaaccagattgagtatccataataactaatttaagtaattttatccccattctctgctaaatcatatttcataatataaaatgtaaccacttccctctatccaaagcttttggtcagactctccattgagttagagaaattggactttggcaaaaagcaacataaagattattgttgttcctagaaccattgttgccatggacccctcatttgctcctcaactttttcaaccaaattatagcgggaaagattcctgatgaagccaagactgcaaacaggaagaatacctagctagtaaactatgcaaaatcacaacaaagattcatttataattccatgttacagtgtttgatagtcctaagtatttaatattggtatattatgtcacagccatgaactgtcaacttacacaaaatccaaacgcactttcatttaaaatcaagattagcctatttcattttcaggaaaaaacagttgtcagaattgcttttttgacctctgcagggatgttttcacattgctattcttatgaccctttatcagagagggaataagtgtagtgttcactttcatctccttagggttgactgcaccagcatcttccatcaagcagtcgccttccaccttagaacctgttcacagttaataaagcaagggggaatatgcatttcatattaggaacagatttcttaagtgattgttatgaaaagtggaaaccagtttagaaccatttttttaccctaaaacatccattgtagtttgttgaaagagcaatgacttttagaagtgcttggtactcaaacaacacaaaatgtgcagattcacgatatattgaaaattatagagttctttttagtctatgttctagtgactttgtttacactagttgtggcattttgtatactacaatgtaaattctactataacactaatgttactatgggaattaattttgcaacttcttaaatgtttttgtcactgcaaccatattggtgagatattgggggtattaaaaatgcctctgcctttaagggttaattcaccagaaataattgattcatgcattgacaaaggaaacaatgcaaaaatttcatgtgggatgtttttaataccattatgctaagcagtacttgttggcttttttcaaaatctgattcatgctaagcagatccttttttctacttaaacaaagatactgcaatgtataatatagaaattttgtatgtactgttgacctatcacctgactgctgacaggatgtgtgaaaatattttaactttgtgactttagggtcaattatgaaacaattgtgatcaaaattcagttgcttctgggaagtttgtggtgattatcactttatttaacgtttgttctcaaaaaatggtcattttgaaaagtgaattggcaggtggaagcttttagcccaaaagaaatctgggtttcagcacaataaactgtatttcatcagggaggactaactttgctttttttcacactttatttaaatgtggatattttttcatgatacagaataaaatgtgcattttatggaattaatttgaa

SEQ ID NO: 10479 - DNA, 2711 bp, Homo sapiens
  ENST00000420622
atgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggata

SEQ ID NO: 10480 - DNA, 2490 bp, Homo sapiens
  ENST00000394968
tgagcaaatgaaagacaccaacaaaatccaacacataaagattcacacttgaaacagattaatcaggaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggggatggttctccatggcaaacgctctgtgaagggtgacctgctgggtgtgaaactgctgcacgacttcctacttcacccattcatctatccgagttttcacggagtccaggagaaagtataaaagttaccttgaggagcaggagagtggaatggttaagactgtttggaatctgaccccttggatttgcatcctggacacacagttgtgtgacctaagggaaaccacttaaactctttatgcctcaatttgcttctctgtgataaaagaataatatgacctgtgtcctacagtagagaataataggtcctagctcgtaaaatgttctcattccatgacacttaaatgagaaaatacgtgtgtggaagtgaccactttgctatatacagatattttattatcattttacaatgccattattttgttccatagtcaaaagtaaaataaaacaaatgtcaatttgtcttattctaatcct

SEQ ID NO: 10481 - DNA, 1849 bp, Homo sapiens
  ENST00000394964
acgtcacgctatttttttttttttttttttttgtatttttagtagagacggagtttcacgtgttagccaggatggtctggatcttctgaccttgtgatctgcccgcctcggcctcccaaagtgctgggattacaggcgtgagccaccgcgcccggccgaagactgaatttttgagcaaatgaaagacaccaacaaaatccaacacataaagattcacacttgaaacagattaatcaggaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctgtaagtattttaattttttcattgaaaattattgttattggcaattttcctggctacaatctcagataggatgaaaacgaactactttgtttacagaaaggtatttaatccatcttatttgcaattgttttttttaatctaccttagaaaatagaaatgcaaaataatatattttactcttcaggacataataatgtgtgaaaaacatattaatgtgtgtacccagcagtgctctcttgaaggaaccaggaccagcatccagagaggtggcgtttcgcacattccatagattttgttggtaatgtgttaaattcc

SEQ ID NO: 10482 - DNA, 4113 bp, Homo sapiens
  ENST00000332142
caaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcacctccaggagacaccctcgttcactgtggggatgtcctcactgcactttatttcttatccagaggctccattgaaattctcaaagatgacattgtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcctcaactcat

SEQ ID NO: 10483 - DNA, 2434 bp, Homo sapiens
  ENST00000328032
ggccccctccggaaggtgaggggaatggattggactccggtggggaaagcgggtgtctagaagtggtgctaatgggaagagaattctggtttcaaaagaggatgctctgccacaaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataaaagccggaatcaccagctttgaa

SEQ ID NO: 10484 - DNA, 1296 bp, Homo sapiens
  ENST00000477019
gcttagtaaacaagtaacatgaatgaagaaggccaggagtaaaaatatagagagaagtgaagactggaaaactggagaacatctttatcttatttgaagtggcccataacccttcagctctacttcatggcagggacattttattttcttccatatagacctaatattttgcaaataattgcctgccaatggttcttcaagtgtgagaccatcagcatcaccttgcaatgtgtttgaagtgcaagttcttgggccctacaccagaacaactgattcggaaacacagaaattcaccaagctgtgttttaacaaacacttcaggtcattctgatgcccaagaagggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggatctctttatccctacatcacgagggccttagtagaacacctggcagaatggagttcatcaaatgtttgctgaataaatgagtgcataaatggatggaagagttagccaagggaagggataagaattccaggtagaaaaaaacacaagaacaaagttatgaaagcagtaaagtccatatgactttttagaacaagtggttttctgagctggcgagaggctagtctggaaaatttaccttcaaaataacacttttctaccttttcacataagtgccatgggggtttgagtaaaatgcaacagtttccatc

SEQ ID NO: 10485 - DNA, 1893 bp, Homo sapiens
  ENST00000621889
gggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataa

SEQ ID NO: 10486 - DNA, 3713 bp, Homo sapiens
  ENST00000618399
aaaaataggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcacctccaggagacaccctcgttcactgtggggatgtcctcactgcactttatttcttatccagaggctccattgaaattctcaaagatgacattgtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcctcaactcat

SEQ ID NO: 10487 - DNA, 5137 bp, Homo sapiens
  ENST00000328405
gggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgaaaaaggagatgtagtactttttctggcctcgttcaaagatataacagatacaaaagtgaagattactccagaagataaaaaagaagacaaagtcaaaggaagatcaagagcagggacccactttgactcagcccggagacggagtcgagcagtcctttatcacatctctgggcacctgcaaagaagagaaaagaacaaattgaaaataaataacaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttgggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtgatatcaagactatcaaacaaatctatggtctcacagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggattgttgatggaattgaagatggaaacagcagtgaagaaagtcagacttttgattttggctctgaacgaatcagatcagagcccagaatttctcctcctcttggagatccagagattggagctgctgttctcttcatcaaagcagaggagaccaagcagcagataaacaaactcaacagtgaggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaagaaatgaatgttttcttttcattttggtaaaaaaaaagcttgctgttttaacaagaaatgcactactgttgtgtatagtagatcaaaaattatttattactaagaggatgtagtttccaaaggaatcccccattttttctgcatgcagtttgcaacaaatgtattctcatgcttctggattataaaagaaaagtgaagtcatattttgttaatgaaataaaaacatggactgagtgtcaactacatgagctttggcatggggatagagaggctccatctaggctctgccaactcatgtcaatgacatgatttaaggtcgttgtgccagcagaaatgtctctcctctaggtatcgtattttgttgctcaagaatccaaaatgggtctgtggacatagggcaatttggggctcaaagtgagggagaaaacctgggtgtgtcctttcccagtgcttttcttttacaagaggtagtagactagtggaaatccccaaatggagccaagacttctgagctataacttgtgggagtaataccagcttgcaatgggtcagcactttaccttttttctttaaggctcccaacaatgctatacagcgcagttgtttccattcctatttttaataaatctcaggggaagcctcagagattacacagttaggatgctgacacagtctagaatccataatgctccctacatctcacactaacaggcaaattcagatgctgggattggcaatgatttaagcaccttcactaaagtcttattttatgttttagaacagttacagtctaattgtcttggacattttgggaagatatattgggttcacattctggagttctctttattttccaccacaaaaaataatctgagaattgtatcattaaaagtatctaaacacaccaa

SEQ ID NO: 10488 - DNA, 5082 bp, Homo sapiens
  ENST00000452398
gccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgaaaaaggagatgtagtactttttctggcctcgttcaaagatataacagatacaaaagtgaagattactccagaagataaaaaagaagacaaagtcaaaggaagatcaagagcagggacccactttgactcagcccggagacggagtcgagcagtcctttatcacatctctgggcacctgcaaagaagagaaaagaacaaattgaaaataaataacgtacttcaggatccctgaacacatcacattaatctgcccttccctcaatgagtgagacaagaacacaacattgtgacctacaaaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgaggtaatgttcatttctcatgttgttttcaggcagaaagcacatattctaaggtaaacgcaagatgttctaatgcaggtatcagaagtgaaaagcataccaacttctttattcctttacatttttaattattcatgaatcccaatccatcttctttcacttgctttggcttgtgttttcacaatgccaatttggattgaccgaagttttatattaacttgctgcttattcgatcaggtggatttattttccttcttattgtctcttttcaaaggaatcaattcttacgataatttaacagtgtaatctgggataattatattaatcaagtttctgtttcccttaacatcaataaagttaaaaaattccatcaaaggggttatctttatacttccagaaacaccccagactgccactataaaaacagtattatataaatcaacgaaccatttcatcaacccaccagccaaacctgtaaccaacattttagtagtgattaattggtttctcctctcttcgcataatcaccagtgggtccaaattccatatcttctgtcctgactaggactctctgtgagaaggaagtcacaatgagttatatgttttcctgctagaggcttttttaatttgttctgtttctccagacttcttatcagctgattattcagtagcacataattcacagtcactgaaaaatctctccaggattatacatacttagatttcctcttctgtatgctggatggccaaacagcaggagacagtaggaagagcatccctgctgtcttgcaaagtaaatcagttagactacacttaccccaatttgatttcctccttcatcttctctgacagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttgggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtgatatcaagactatcaaacaaatctatggtctcacagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggattgttgatggaattgaagatggaaacagcagtgaagaaagtcagacttttgattttggctctgaacgaatcagatcagagcccagaatttctcctcctcttggagatccagagattggagctgctgttctcttcatcaaagcagaggagaccaagcagcagataaacaaactcaacagtgaggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaag

SEQ ID NO: 10489 - DNA, 652 bp, Homo sapiens
  ENST00000475063
acagaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtgttgggaggttgacagtgccaacatctttaaaacgtttatgactcaactgaaaggaaagctcccaggaaaaatctagtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggag

SEQ ID NO: 10490 - DNA, 576 bp, Homo sapiens
  ENST00000518527
aagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagatggagtcaaaagtggaactggggcccgcagagccggatagcttgggcagtacgtgtgtgcacctgcaggctgtggagacaggtatttccatggagct

SEQ ID NO: 10491 - DNA, 1197 bp, Homo sapiens
  ENST00000377360
aagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaaga

SEQ ID NO: 10492 - DNA, 639 bp, Homo sapiens
  ENST00000517344
caggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagatggagtcaaaagtggaactggggcccgcagagccggatagcttgggcagtacgtgtgtgcacctgcaggctgtggagacaggtatttccatggagctcactcgccctgcctctcatccaggcctgaaaatcatagagcatcccgctggccatctgcatcagcccgacccccacaggatagaagactggcacatccaagttgctccttccacaccctctccccactgaggcctcgtctcctccgccctgtggccaattgaagactcagcatcatcaagactggagggacagagcatttgaatcatcagacgctgggccagacgtcaccccacgcgttttctcattttatcgtcctaagaagcc

SEQ ID NO: 10493 - DNA, 2014 bp, Homo sapiens
  ENST00000328939
gctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaa

SEQ ID NO: 10494 - DNA, 1845 bp, Homo sapiens
  ENST00000520740
ggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctggataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttaca

SEQ ID NO: 10495 - DNA, 726 bp, Homo sapiens
  ENST00000434108
atgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 10496 - DNA, 684 bp, Homo sapiens
  ENST00000411494
atgggggccgtcatgggcaccttctcatctctgcaaaccaaacaaaggcgaccctcgaaagacatcgcctggtggtattaccagtatcagagagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 10497 - DNA, 1613 bp, Homo sapiens
  ENST00000636734
gactggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacgataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaa

SEQ ID NO: 10498 - DNA, 2249 bp, Homo sapiens
  ENST00000390656
gctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctggataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctc

SEQ ID NO: 10499 - DNA, 1448 bp, Homo sapiens
  ENST00000616807
gacatcgcctggtggtattaccagtatcagagagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctc

SEQ ID NO: 10500 - DNA, 2089 bp, Homo sapiens
  ENST00000348850
tggagcttagacgccgagctcgccgccaaaccatgaaccgatgcccccgcaggtgccggagcccgctggggcaggcagcgcgatccctctaccagctggtgactgggtcgctgtccccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgca

SEQ ID NO: 10501 - DNA, 2617 bp, Homo sapiens
  ENST00000355657
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaactcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgca

SEQ ID NO: 10502 - DNA, 1989 bp, Homo sapiens
  ENST00000356640
gagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctc

SEQ ID NO: 10503 - DNA, 428 bp, Homo sapiens
  ENST00000460388
gggcaagtacacgtaccctgcactccgggaggaggccccaagggaacacgtggagagcttcttccagaagatggacagaaacaaggatggtgtggtgaccattgaggaattcattgagtcttgtcaaaaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaaga

SEQ ID NO: 10504 - DNA, 923 bp, Homo sapiens
  ENST00000370046
ctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaagg

SEQ ID NO: 10505 - DNA, 847 bp, Homo sapiens
  ENST00000472764
atgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccag

SEQ ID NO: 10506 - DNA, 534 bp, Homo sapiens
  ENST00000434163
atgtggcttagctggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 10507 - DNA, 684 bp, Homo sapiens
  ENST00000353068
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaaccctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 10508 - DNA, 858 bp, Homo sapiens
  ENST00000461105
atgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 10509 - DNA, 663 bp, Homo sapiens
  ENST00000343195
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 10510 - DNA, 555 bp, Homo sapiens
  ENST00000239117
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggtacagctccctgccctctacattaccctgacctggactcaggcctga

SEQ ID NO: 10511 - DNA, 736 bp, Homo sapiens
  ENST00000483385
ctcagacgccccctcttgaactggcttttcccactcctccctttctaaaacgaagatgcggctgggggccttcccctccaacgagggatcgagggccgcggggcgagcactgagtcggatccctggctctggggccaggccaggccttggcccgctgatagacctcgaagatggccatcatcttttctccttacctcagtgtccttggctcggggcccagggaactggcagcctggtctccggcatcggatgggaccggggggcggggagggggtgaatggggcagtgatttgaagaggggtcgcggaggctgggcctgaggcgcggctgtcctcaccgctcccgcagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggtgagctgggcgaggtgggccagggaagcctgtttcctggagttcagggccaggatctccaggccaaacccagagaaggagttgggtgaagagtacccgaggacacagctccctcctgcctc

SEQ ID NO: 10512 - DNA, 2489 bp, Homo sapiens
  ENST00000358038
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgc

SEQ ID NO: 10513 - DNA, 2481 bp, Homo sapiens
  ENST00000382148
aactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtt

SEQ ID NO: 10514 - DNA, 1641 bp, Homo sapiens
  ENST00000447367
agcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcgacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagta

SEQ ID NO: 10515 - DNA, 1645 bp, Homo sapiens
  ENST00000382150
aatgtagtttaatggctttacaaagaaagccaggcagaggagcacttctcagtggctgtggtcggaccatgacctagctgaccatgaacttggaagggcttgaaatgatagcagttctgatcgtcattgtgctttttgttaaattattggaacagtttgggctgattgaagcaggtttagaagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataaca

SEQ ID NO: 10516 - DNA, 1767 bp, Homo sapiens
  ENST00000382152
ctgcagcccgctccgcgcgccctgcccgcagccgccgccgaagctctcgctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcct

SEQ ID NO: 10517 - DNA, 1301 bp, Homo sapiens
  ENST00000509207
aagatggaggctctgtgtgagaaggaatgcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaactacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttga

SEQ ID NO: 10518 - DNA, 868 bp, Homo sapiens
  ENST00000382149
atgttgactctggagtgggagtccgaaggactgcaaacagtgggtattgttgtgattatatgtgcatctctgaagcttcttcatttgctgggactgattgatttttcggaagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttca

SEQ ID NO: 10519 - DNA, 763 bp, Homo sapiens
  ENST00000515786
atgaatgtgaggagggtggaaagcatttcggctcagctggaggaggccagctctacaggcgaagcggttattgagcattcgctgtgtaccaagtgctgtccttgacaagaagacttacacccagtggtcccagagggagacttcggaagtgggagcacctgtcagatcatcatacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaa

SEQ ID NO: 10520 - DNA, 456 bp, Homo sapiens
  ENST00000515373
ggtttcctgtacgctcagaacagcaccaagcgcagcattaaagagcggctcatgaagctcttgccctgctcagctgccaaaacgtcgtctcctgctattcaaagcaacgtggaagatgaactggagatggccaccgtcaggcatcggcctgaagcccttgagcttctggaagcccagagcaaatttaccaagaaagagcttcagatcctttacagaggatttaagaatgtaagaactttctttttgactttaccttcacacaattcccagaggagcattgagaaatgagaggaaaagggggaaaatatcccattctatgagagccccatcatatgtatatttcatactgatccttcccagataggaatataatcagtatctgtggactttgattctctgtggcacacccatgctggcatactgtgattgcccattaaacaaagagtttctgagaaa

SEQ ID NO: 10521 - DNA, 421 bp, Homo sapiens
  ENST00000512102
aatgaagaataaagagtgggctagcgacttccaggggatagaacagaagcggttattgagcattcgctgtgtaccaagtgctgtccttgacaagaagacttacacccagtggtcccagagggagacttcggaagtgggagcacctgtcagatcatcatcaaggaaccagatttacctcccacctgaaacaaatgatgaacaagcaaaaccataaaataactgtttttagacattgagcttcaggcattgaagaacagtgattcttcaatcactgttgattgaacagtgatattgggaagcaagccaacaatttgtgcttcagggagagttttccaaaccaattgttattaatgagtcacacatcatatctgatttatgatttattaaactttatgcattaaatactttccaaacaagacaa

SEQ ID NO: 10522 - DNA, 2168 bp, Homo sapiens
  ENST00000359001
gtggacagtcacagacattagcagacatgttcttccgttttcctttgttgctctgtgtaagcatcggtgagcagtggctggtcctaagactctttcttgttttcctccacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtt

SEQ ID NO: 10523 - DNA, 267 bp, Homo sapiens
  ENST00000629874
aagatggaggctctgtgtgagaaggaatgcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaact

SEQ ID NO: 10524 - DNA, 425 bp, Homo sapiens
  ENST00000629040
aactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacag

SEQ ID NO: 10525 - DNA, 263 bp, Homo sapiens
  ENST00000630138
caaggaaccagatttacctcccacctgaaacaaatgatgaacaagcaaaaccataaaataactgtttttagacattgagcttcaggcattgaagaacagtgattcttcaatcactgttgattgaacagtgatattgggaagcaagccaacaatttgtgcttcagggagagttttccaaaccaattgttattaatgagtcacacatcatatctgatttatgatttattaaactttatgcattaaatactttccaaacaagacaa

SEQ ID NO: 10526 - DNA, 1546 bp, Homo sapiens
  ENST00000639408
gagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggcagcccagagaagatctgtttccctgtgtcctgtgaatggaaggacccaagccaatatgttcctttgaaaagagtccagtacccaggccccatggaaagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccctggggttagtgttgctttggttgaaaggaagcatgaaaaagttcttctatgatttcattttttttaatccaactctttaatccatttagaatttattttgatataaagaatgaggtggaacattagcttaatttttctcctgaagtttagccaatgatctgaccatcttttaaatgattttaaatgccaccttgatattatgttaaattatactaaatgctcaagtatactttggtctatgcttgtctggaagagacattccaatgttccctctctcttttagctttagtaataaactttcaaattcatctggactcatgggtcttctaaatcattactatgtctcccaacttcttttgctgctagctatggctgttgatatagaagcaggaatattgtatgtaactttcaggatggtcctgaataagaggggccatgctccttttcaccccttttcctcctttctgacaactgtgatgtaaataaaaagaactctggcagcca

SEQ ID NO: 10527 - DNA, 1239 bp, Homo sapiens
  ENST00000637644
gtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccctggggttagtgttgctttggttgaaaggaagcatgaaaaagttcttctatgatttcattttttttaatccaactctttaatccatttagaatttattttgatataaagaatgaggtggaacattagcttaatttttctcctgaagtttagccaatgatctgaccatcttttaaatgattttaaatgccaccttgatattatgttaaattatactaaatgctcaagtatactttggtctatgcttgtctggaagagacattccaatgttccctctctcttttagctttagtaataaactttcaaattcatctgga

SEQ ID NO: 10528 - DNA, 565 bp, Homo sapiens
  ENST00000640914
caagccctgcctcatgatccgagttgccaatatgcgcaaaagcctcctcattggctgccaggtgacaggaaaactgcttcagacccaccaaaccaaggaaggggagaacatccggctcaaccaggcagcccagagaagatctgtttccctgtgtcctgtgaatggaaggacccaagccaatatgttcctttgaaaagagtccagtacccaggccccatggaaagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccct

SEQ ID NO: 10529 - DNA, 870 bp, Homo sapiens
  ENST00000509700
gtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagag

SEQ ID NO: 10530 - DNA, 5528 bp, Homo sapiens
  ENST00000368089
atctctctttctccccgggtctgtctgggtctctgtctttggatatttctctctgcgcctgcagctgtctgggtctccgcttccttgccccgcacgccccgccccctgcccaagaccctccaatctcggcggctcgagcctggcgctccactctcccattggtctgttcggagccccccgcccccgcctgcccggcccccctccgggcccctccattcacacaaagtttggctccggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactcaggagctgaacactttggtgtatgggaggcactaatgggaagcctcaaccctggaatccaaatgccaggactaatagctgttaggctgaagatctcccaaggtcaaggcccagccttttgtgtggctgcaagcagcccaaagagaaagccatggattccagaagagttccaatcctggcatttgggcatggagggtgatgctttggttttgatgcttctgaatgaaaatgaggagtggggttaccagctgctctaggggatggtgaagttccatgagaggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggttgtca

SEQ ID NO: 10531 - DNA, 1184 bp, Homo sapiens
  ENST00000636689
cacagctctgctcctaactcctgcccgccccgtccgtccatctgtcccgctgccccgcggcccatccaaggggccactccacctcggacccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcacca

SEQ ID NO: 10532 - DNA, 3260 bp, Homo sapiens
  ENST00000638840
tggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcac

SEQ ID NO: 10533 - DNA, 2968 bp, Homo sapiens
  ENST00000640017
cagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgcc

SEQ ID NO: 10534 - DNA, 4351 bp, Homo sapiens
  ENST00000638728
gctcctaactcctgcccgccccgtccgtccatctgtcccgctgccccgcggcccatccaaggggccactccacctcggacccaaggatggttttgaacttctgatctcaagtgatcctcctgcctcagcctcccaaagtgctgggatacagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacact

SEQ ID NO: 10535 - DNA, 3883 bp, Homo sapiens
  ENST00000638868
gcatcactgtgcataagctcatttacagctccagcttggttggcttgagctacaaggaagtgactggcagaggacccggggaccttccttcccttgaccttccttgggaccagagaggctgggacacttggatcacggatggttttgaacttctgatctcaagtgatcctcctgcctcagcctcccaaagtgctgggatacagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaag

SEQ ID NO: 10536 - DNA, 5425 bp, Homo sapiens
  ENST00000583088
cgcgcgcgtcccagtgcgcaagtggctggcggtgtgtgtgtagggggcggcccgggactaggaggggctcggggccaggccggagccgtggtaggctggtgcagcggctgcgcggcgcggcgcggcgcggggcgggcgtgctctccgcggagagttagaggagttgccgagctgagctccggtggagcgaggcgcggagctgggtgcgcgccgagcctctgcctcccgccgcctcctcgccctccattcctcgctccccgtcttctcccggccacaccgccactgctgccgcctccctgggaacagtagccgggggagggggactggcgcggtcagagcctgcgaggaggtgcggggcgccggggcgtaggggagcgcgccgggccctgcccgagatcagataacagccggcgggggagggggtgggccggccgtgctcacagccggaccgagggaccgacgccagccgccccggcccaagcgagcgcccagcggccgggggcgccgtccaggcgcgcgcccccgacccgtggctggaccagggcgatccgctttgcagagaagacgcgcccctcggcatggagcgcccccgggagctgccctgaggcggtggcggcagcggcggcgatgcagccagcgcggcagctgccggggccaggaacggccgcccggagcttggaggacgccgagcgcgccgcgcccgggccactgaccgaggatgttctagtgactggatcctttccagttggtgcctgggaaatggcagccactactaattcagccttgaagacagtaccgtgcccactcagcaccattacatagaagatagaactcaagaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaattaccatgcaattgaaaaaatttttttttaattcacagggggcaaaaagaacaattagaattccatgggtctgccaggatgcagcagctggctgaaggctccagagggttccccgaggtgggactggcctctccccgtgtgtgtgggcaccacagtccctgggcaagcagggtgctctgggaccgcacttcatcgagctcacgagccagctaggctctgtttgtgatagaaaaatcaagaccatgttaatgatcgtaataaaagctttctactgtcgttggggtggtgggtggggctgggaagaaactggtttgagcttttagagtttgcctttgtaccttagagatgtgtctcagggccaggcatgggacctgccatcgagggttcctccccgcaccctcgattttcctgttttgcttctctctccatttctgtccaggcctccgcccaattccacagtgaggggtggttaggagctataggccgggatggctccttgggaagggaagtcgggatcccaggctaggaggaagctggcagccccgtccccactgggcccacagtgtgagtcgtgccttagagactccgggttgtcctgttctttctgggcttgctcatctccccccaaccctgtcccaccccacccctcccatacctccactgctgaagttcctccagcccctctgtctgccttgtgaaggtggcaggggccaggtctgcctgacataggaccacatcctgtccctccctcacctggagcagcacagcagagttcaggcagggcacagccaggccctggtcagcgctgaatggcagaggaaagatcttaggaaaggagaggaatcgccaccccctcctgccaactgggatgactggggagggccacgctcattcaaagctgaatcagaaaccagccgtggaacagaattcctgccgagtcttccagggccgctcctccaccaccctcccccaggttgaggcactatggcaccctcatcaggaagaggtttggggtccccttgttgtcactgctggctctgccaccccatcttgttcatggcagctggttgggtcaggtccatggtagagccaggcccttcccagggctgcggagaaaacctgctctcttctagtcgggcttctccagaagccagtaatcagaaaggatgtgtctcctgctccaactctgcccccgagacagctcagagccagaaggcaccccgagacagctcagagccagaaggcaccccgagacagctcagagccagaaggcaccgaggactctggcccaagtggggaagctgaggcagagagcagagggggtcatgcagtgagtgggtggggtgcaggagacagagaggggctgggggcgtggggtgggggtgtctgcctcttccctccacctcctcccctccttagcagctgaagactcagccctgaggtctggggcaatggaagtcaagacacccgacccctacatcctggggtaggcccgactcagcatcctgtcccagcttcagccccacactcatttctggcatagaagattccgccgaggcagctctttcctctcggggtctgccaggggtgcctcagctggttcctgctcccaggcctagccccgaagccttaggggccttctcagccttagccctgggtactggggtgaagttggcaggggagagcttgacacttcgcctccctgatggccatgctgagggacagtggtgaccctggtcacttggtgctggtgtaggggcctgtgcccttccagggccagtgagacagccttctactcccccgacccagagctgagtccgaggaccccaggcccacctcctggccctcttggaggtctgtgctcttacctcccagcccccaccctgcgggagagcagccccagcgcctcatctccccaaaggcggcagatgcttgattctcctgccctctttcttccttccctcgtatttatttatttatttattgcttgtgctaaagaccaaaatagtctccctctttagtgcacttgaagcgggagggcggatgggatgagccaggagcgaggaagacttggcccctggggagtgtgtgtgtggaggcgtgtgcctgtgtgagcctgcatgcatacatgtgtggtgcacacatgcacactcggctcttcatgtgtatgactgggttagtaatacagatacgtgatctatacgtgtgtgtgtgtgtgtgtgtgtgtgtgtgtgtgtatgcaggcggttatgtgtctgtctacccccaggtgtttccgtgtacaagtttcctgtgagggagggcacccacccatcaggttgggcactggcacaggtgaaccccacagtccccgaccctctgccctgattatgcacgtctgctcctgagtggagcttgtgttccaggatgagacatctggaggtgagcgtgtgcgtccggctcgtgtgtaggaggctgtgtgtgtgcccatgtgaaaccgtgtacttgagtgtgtgtctgtgtgcagcctatgcctgctgctcagagcacggtggccaccccctgagcctctgctggtgctgtgctgcgtggtccccacccagagggtcctggggggcggggaggagccaccgttgggaggcccctgtacggggtgtctgccctgcgtgagggcatagaatgtcaaattattttaaatggtgaaactggagagttttcatgttattttcaatacatagcagtatctaaagacgtaggcgatgagactagaccacattaaatgcattttgatctctttgagg

SEQ ID NO: 10537 - DNA, 2198 bp, Homo sapiens
  ENST00000331718
agcaggccacagggaggcttgggcacagccagctttccgtcctgttgggaagcctgtttctgctttcagtgcccacgtggtgtcaggaacgccggtcacagtgaacgcctgcaggacccacactgctgcatcgtctctgtgggacagatactgaagccagggcttggcttacccttgtgacagtctcccgaggatgttctagtgactggatcctttccagttggtgcctgggaaatggcagccactactaattcagccttgaagacagtaccgtgcccactcagcaccattacatagaagatagaactcaagaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaattaccatgcaattgaaaaaatttttttttaattcacagggggcaaaaagaacaattagaattccatgggtctgccagg

SEQ ID NO: 10538 - DNA, 569 bp, Homo sapiens
  ENST00000591891
ttatccagacaggggaattgcaatggagagagagtaattcaagcagagtcagctgtgtgggagatcggagttttattattactcaaatcagtctcccagatcagagtttttaaggatagtttgtcgggtatgggcttggaaagtgaggagtgctaattggttgggttgaaggtaaaatcatagggggtcgaaacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgat

SEQ ID NO: 10539 - DNA, 1698 bp, Homo sapiens
  ENST00000588112
aggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggtaagaaattaaaccaattttaacatgattctccgaaaaaccaatacttgcactccttcctccatgaaaatgtgctttatccctacgcatttttccagaagtccagctttctacttatacgtttatattttcataaactttgctacagagcaaattcggtgttacaaacattgcttccttttgttcacattttacacgtttactgcctccttaaatcattcaccttcactgtattttaggaaagaaatgctatttatatattttgtgaatccacagtctattatacattctgctaactaagaataaaacttgtctacttggttatttgagtctagagaatgattttcaacctggagtgactttgctcaccaagggacatctggcaatgtctggtcacatttttggatgtctctactggggtttggggtcatactggcatctagtgggaagagtttagggatgctgttaaactaaatgccataaccacaggtcatcttcccacaacaaagaattttctggccctaaatattgaggttgagaaacccagatctaggatattctgtgcatttaaaatgattccgttcagaacaatttaggtactttctcaatagtactgcaaaagctatatgaaaactatatgtatataaaaattatatctatctgtctctagctacattaacatatcaatctgctaggttaagtagactcaatttaaccatctggtgtttcatgtttgcttttgatttgtaaaagactcagacctataacatagccttaatgctaatatcattcttgagataaacgattataattgcagatttctttttttttgagaaagagtctcgctctgtcacccaggctggagtgcagtggcaccatctcagctcactgcaaactccacctcccaggttcaaacaattctcctgcctcagcttcccgagtagctgggattacaggtgcccgctaccaatacttgcagatttctttagtgttatgttatttagccactcatccatttttttaaagatttaagtattaagcattcactgtacaccaagcaatgttcttagtgaacaagtaatttagaattagattacaattaaattgtggattttaggacattttagttaacgtttactgaaaagtattatcacagaatttatattttctatagtttatgttgttttatatgattataaaagcaatgatttaagaattaagtgaagtattttacatgatgtggaaaaaatgagagaaaaagatggaaaagagttgattgaattattcattttcacctgattagttgaagccagtggttagtaacatcacatgcacaaaggacccagtggctgattcaaaatagtattccattctctccccatgattttacaatgaaactacgagaccaatcaggacaccttcttctttcttcttgttcaccaaa

SEQ ID NO: 10540 - DNA, 3684 bp, Homo sapiens
  ENST00000589377
gagcattctctaccattgcccagctgaaagcacctagctcatagattctctgtggggagagtgaataaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 10541 - DNA, 1897 bp, Homo sapiens
  ENST00000586462
acaatcttttgtactattgatgtgacaatatgtacattaagtggggtgaagaattaagtcattctcttcataatcaggtgataacaaccttctcctttattgagaatcaagcatctcagagcgagcgtgaatggatattagagtttctgcctcagtgttctcaacagcttctactggtaaagcaagttacagctagtaacttggtcagggtttttggatataaactttattgtttagagtgtagaccaacctacatttaaaatatgatacttcagaagtgcagaaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttaca

SEQ ID NO: 10542 - DNA, 4014 bp, Homo sapiens
  ENST00000585558
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 10543 - DNA, 589 bp, Homo sapiens
  ENST00000587698
gagatgctcagctacggtgctcttacaagatgaaaaggacatggggttcagatctgcacttcatcatctttcactaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactc

SEQ ID NO: 10544 - DNA, 582 bp, Homo sapiens
  ENST00000587892
gatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgatt

SEQ ID NO: 10545 - DNA, 4062 bp, Homo sapiens
  ENST00000283936
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 10546 - DNA, 4009 bp, Homo sapiens
  ENST00000392670
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 10547 - DNA, 3981 bp, Homo sapiens
  ENST00000392671
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 10548 - DNA, 4190 bp, Homo sapiens
  ENST00000615244
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 10549 - DNA, 5021 bp, Homo sapiens
  ENST00000295101
caggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaaggcctccgtcccaggggagaaggagaggcgtctgcagggggcagagaccgcagctacctgccgggtgcgccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgtttgaacctgggaggcggaggttgcagtgagccaagattctgccactgcactccagcctgggtgacagtgcgagactccatctcaacatcaaaaaaaaaaaaaaaaaaaaaaaaaaaaaaaaaaaaaaaaagaataaaaacagggtaacataatgcaaagtaactgtgtggaataaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttctt

SEQ ID NO: 10550 - DNA, 564 bp, Homo sapiens
  ENST00000493505
attgttggaccaggcatttctccaaagctcatgagttagggaatgtctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattact

SEQ ID NO: 10551 - DNA, 4523 bp, Homo sapiens
  ENST00000544049
ctccgtcccaggggagaaggagaggcgtctgcagggggcagagaccgcagctacctgccgggtgcgccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaaggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgtttgaacctgggaggcggaggttgcagtgagccaagattctgccactgcactccagcctgggtgacagtgcgagactccatctcaacatcaaaaaaaaaaaaaaaaaaaaaaaaaaaaaaaaaaaaaaaaagaataaaaacagggtaacataatgcaaagtaactgtgtggaataaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttc

SEQ ID NO: 10552 - DNA, 2065 bp, Homo sapiens
  ENST00000303592
gggagcggcgcgggacggccgggacgcgcggagaccccaagacccacgcgcagaccgagcggcagccggggaggggagcgcgggccggccggccgagttcgcgggcagggggcgccgggactcccctttccgcgcccgggacgccgcccgccggatcgcgccttgggatgtagcgcccgctcgccgcctcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaa

SEQ ID NO: 10553 - DNA, 19645 bp, Homo sapiens
  ENST00000609713
ggagccgcgtcgcttcgtgcgctgccagcggggctcagccagtcggctggaattgagtagcattcattgaatctgcggatttcatgacgtctctctgcgtggtccaccacttttctcctaaccggggattttttttttcttctgccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccagagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggacgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagcaaaaaaaaaaagaaagaaagaaagattcctaacatgcagtaggcatttctgttttgatgtctgtgttttccaggttattttgatccagttgacggctggcccttcagtgcatggcctttgtttgtgtctcagactggcagacgttagggtacctcactgttcccacacggatcctttcattgaatccaacaagccataggtctgggggaaattgagaggtctggtagatggcaaaacccaccaccaatatgctgatatactgtgaaatgttacaaaacagatgtctttttttaaaagataacaagggcctcactaactggcctggaggagggggaataccaggaaggaaatattctctagcctgtcaccaaaggtatgtttttacttttcacatgagctcttgccctttgtagtacaataatttaggaaacttttctgcaaaaccattgattctccagctgtagtttctctacactcttacaatgagacatggtaagttagcagaagatggtttgggtctaaagccgtgaaattcacaaaggcatgtagtgagtggcatgcattataatcatcgacctctcactttgactctatctggctttctgagaatgacatctcgcctgtccctggggcttatccatcagcatttcttgcattgtgatcttttattattttgaaatgaccagagttcagtattcaaagattagatcaacaatcttgatgattgtctaagaaatgtctctagagtatgccacaggctagaaatcaaatccagtgtctgtcaatcaaaagaaaacaaataaaaaaattccagccttaattcactttaatctgcaaaaaggaaagaagggaggaagggagggaggaaggaaggaaggaaggaagggtatttgtactggaaatctgaattttaaaatgaaaaaaataaggaaacaaatcttagatcaaacctccggggcaggtggagattttgcactgttacagatctttcacattcactttgcatttataagctgtttgttctttaacacagttgcccatcataaatattcattgaatggatccaagtttattttcagctcctacagctgtgctcagtttgaggctctgcaccatggaggtcaaagagatcaaactagctgtccctctttgtttcccttgccttccctgacctgatcgcacaggcctttggtgtagtctggggaccttgtctactaaaaaagaagtcccaggataaggaaagtggctcctaaatataacctcggggcctctcttctcccatctcagagaccttggatcaggacaactgcctcttggcactgactttaaggaaaacaaaactgttggctatagccctttcctgtttgccagcatttccttttttgcattgaatctctgttgaatcatttctttatttcgcacactctaagaaggaggtggtggtccgggaggaggaagctcgatacactccccttgaggctgcggggaggagccatggcttgacctctctgcagcctaatgaagggcactcttggcttggggagctcccctgcaaccttgccagggtcgcagggcaggccatggcaggcacaaaacaagatggaataggggcggcaaaatgtcttctaatttagctcttgaagactcactgggcctttttaattccattgctaaggtttaaaggacagcgcacacccccgtgtctggttggaagagcaagcagctcagggcctcatccctgcttgcctgccctttagcacaactgaacgaagagccttgacaacacgttggccacgtgcacctgtcagttctgtgtctgtgacgggcacccagatgtgaggtctctccctgtttctcactgtctttgttgtcaatgtagttggagacagaacttgaaccaaatctcgtttttgtaatgtgagcctctgaatctttacatggggatgctcctgaagaaccttttactagaatgtccctatcaaacatgtctatttttctacagttgttaacacagtttaacagtgtattttgtgtcaactgttaaaatttggaactgaaagttcattgagactgattttctaagcagcgagtagtgagtgaatggtgttttccattaagacagctcaacaaaattgaccccacaatttccactcattctattccgcaatatccagtcctcattccctcagtcactccattagcaaaccaagtgcaatgagaattttttaaaagtctcttttaatacaacagtatccataactaatgaagatcactctcaactagatcctttggtctgtttggttaatgtatttgagtcatttttccataaagcatggtgggatccgtgagccagataagaatttggaatttaagggttatggtttgccacagttgaccccaatttgacagaacaaagtgctcctggatggaagggcaggttcagctgcaagcatgaccccccaccacaaggctgctgagttcctcggattctcacctccacccaccccaacgtgctctccaactggaagagcacccattcatttataaatcaactttatggaaccaataaaatcatttctgttttagctgtcccctgggtaagctatactcttttacattaacatagcaaatgtcaacttttctgttccttcaaacatggccttccagcctggttgttccagcatatatcccctctatgtccatgaggcagaactctctcttcccccactccgttcttccatctatccccatcctttgctgtttccctggttctccagttccaattctattgttttagttcagtaccttatgttccctaacagaaatccagctgcaaatgtcaacctatttcttaagcacaattttctcttgcaggtctaaccaagctagggctctgaaatgtctatttttcactgcactccaatttaaaaattattcatgacttcatttaatagtctaaattttgaattctccagagcaacattcttatgctttccatccctacattttcttacatttcagttttcttacttttttcccctttgcttttttatttagatttaagccagtgtctttgggatatttagaaactgcttacaaaggtgggaactggtggacagagaaagggggcataagaatgctattagaaaactacctgaactcaccagaagaatgggaaatcatttgatttgctgagagaatacaattaaaatactcatagtaaatcatttccaaaacagtttgctaatagtctggctactcttcagtctttctttccttgacttgggtgatactctgtatgatttaaaaatgtcaggaaggtagttgaaagttcagtgtcctctatatattgtaaacattatcttcaaggatgatttcctttcaatggatggctttaacattgaaaaacataggtaacatatacataatagatgattcattgatattactttacaatacactaaaataacattatcttgtttctgaactttatggccaaccggtatctaagaaaatgttagcctttaatttaaaattgagtaaagcacgcctcttcctaatatttctgcctttaatgtcttgagtgctttagatgcagagtgtcatctagaagtcaaaattctgtcagaaggctgctaagagattttgataaatcacagaatatataataataacccaacaatattttacccaacatggtgtggtgtttgagagcattaagagcacttgtacaaattatcttatttcattctaattcaccatgagaggttgagtattataatttacattttatagagggaaaactagggtttgggcaaattggccaagtttaaaggccagtgaatcatagctccttgtctcaaatccaggtcacagggccctaagctgtgggctatttttactacaaaaaatttcagcaaaccaaatctgctaaaaaaaaaaaaatctggcctgctgcctgttattgtaccacttgtgagctaagagcaatttttacattttttaataattgggggaaaaaaaagaaaagaagaatattttgagacatgtgaaaatcatcctaaattcaaatttcaatgtccacaaacaaagttttattggaacacagccacagccatttgtctgtgtattgcctatggctgcttccacatgcactcacagagctgagtaattacaacagagaccgtgtggccagcaaagattgaaatatttactatctggccctgtataaaaaaagtttgctgacccctgtactgtactgttaagtactattggtactattaagtactagtaatagtactattaataatagtatgtaagagtactaagtactatgaaatattgtactgtactcttaagagagtcctaggcaatatagaagaatgactttttttctagcataaattattgaagtcactcataagtctgttcaaaataacataactcttttttttcggttgtcaaagagacaactgcttcacaagacttagagagcccagtcattcagttagggtctcaaaggaagaatccttccttttcatgccattcctccagagtggcaaatagagtcaacagccagccaggatctagcggtcaactcagaaagtggatacagtaaaattactccttaatgaactacagagaaatgggcattcccagcccagccgctgaaatattgcttcagtggcaccctcaggcgttggatgatgtacatagctcaggctgccagtctctgctcagcaaagcagcccagacctgcagtggttgccacacatcaaacccgcctcgctcctccacatggcttctctcttaggctctcttggaggagagttaaataggtggcccagatgtctccctctgttttcttgctagttttctctagcctacagtttacaactgatcaaggtgatgaacgtgaacctggaactagctcatgtttaattgcgctagtttttgctctctctagccactaagctagaagtttaatgtgtaattaaagaactaaatgcttcttatggaaaaccaaaaggtcctttgaaaagagctcagggagacacggaagtatagtaaagggttgttggatttcttgcgctttctgagtctgaagcaaagacaaagattggtaattacagacataatggatggaaaaagtccagaccttggggtttttagatgagtcaatattaaatggcattctttgtgtcactaagctgaactcccttgtcttctaaggaagcatttctaatgccagaggtagtcagccaagctaggttccttatctttttagttctatggaaaaacatatcaagttctcttatgagtgctttcctggaaatcagatgagaaagaaaaaaaagtaacaatgtaacaaatcattgtgatgttgttatattgtcgacagataaaggatggatttgatcctgcgtctgaaactaagtaggtaatggtatctacaatatagatcatgcaaaaagcttgtgacccttcaactgcatggaagagtgggaggaaacaactaagtgggaggaaacaaatctcaaagttcaacaccataaaacttaaataaatgtaaaaggagtcaaacttttacttggcctcattgccttggtaaaagaaagcttcatgtatccacctaattcaataagagagtcctaggaaaaggaaggcaaaatactttaaaggcacacaaaaatatttcactggggtggtcaacatgattaagtgatggagattagatttatcactgatgaaaacagtatttatagagttatttttagacactataccccctagatgcaaatcccaacatgcactgtggttggccggagaattgtggccacatagtaaacagatcttgatttcagagaatgaaatgttcctaccgactttgtgtaattgcccatttcaagattaaggctcagtgcccattgttttaacaccgatcatcaatactgtgatatcaactaagccaatctttataagaatatgaagggctgtttttctcaggcaatgtaaatatctgctaccaacaagcactagtgaaataaacatgtaatcatcatcgtttctaaaactctgatagaaatcacaaaacattcaagcaaaagggcaaggtcttccaggagcctaggagcagacttttggctacaaagagcctagtccaggctgaatgccttatggagtatgtcagtcttgggtcttatcactaaacacaactagtagaactcgatcaactggagtgcagagatcagagtttcggtcagccgtgcattacccaaacctctgggtcttcagccagtcttcttagaagaggggaaggagcactgtcctcagatccggccatcacgggcatcgccctgacatcatctctcagcattgctgactgtgggcatgggtatgagaaataccctcccgtagctcagacttgggcagaacaaaatcctcagccatgcccacccactgaggtctctctaggggagcttctccctgcagggtctggctcttgcccatctggacaatgaccccctagaagtatcttccgggggaccctgtatctttcaagcttaacttgccccacacccttgaccccacagagcacctccctgggtcaggaatgatgactaaattaagacctttagcatctgctaagcacaggggtgccctcccatgtgaaagtccaagtaaaataaatggagtcagggtaaggaaatccccaaaagttctgattttctcatggtgatgatctcagtgcttttctttttcatgacatatctaattctcttttctctaggaagtctcacgttttggtatcacgatgccgtgggcacagactcagtcatcgggccaatggcagaactctctccagatagtctgacctggtccctctttttgagtaaggctgggagtttggtttgtttgagccaccccacaaccaatagaatcccaccctggctaagaaatctcacaaggccgggtgctgtggctcacacctgtaatctcagcactttgggaggccaaggtggcagatcacctgaggccaggagtttgagaccagcctggccaatatggtaataccccgcctctactaaaaatatgaaaaagttagctgggcatggtagttcctgcctgtacacccagctactctggaggctgaggcacaagaatagcttaaacttgggagggggaggttgcagtaagctgagatcatgccactgcactccagcctgggccacggagcgagactcagtctcaaaaaaagaaagaaaagaaggaaggaaggaaggaaggaaggaaggaaggaaggaaggaaggaaggaaaaaagataaagaaagaaggaaggaaggaaggaaagaaagaaggaaggaaggaagaaggaaagaaagaaagaaaagaaagaaagaaaaagaaagaaaagaaaagaaaagaaaagaaaagaaagaaagaaagaaagaaagaaagaaagaaagaaagaaagagaaaagaaagagaaagaaagaaagagaaaagaaatcgcacatccccacctctatcagggtcaccaaatgaaggcatcaatttcaagtcccgttattatctgcaaggaactctgcattgcagcacttacagacacaacttatgctgtctcctggtgcccacacagctttcgggtgatggcagattgtcagccaaccattccccccagctgctctctcttaatttgctccctcatctcaccacgaaaacttcacttttcctggcacccccgttggaaggttaatatcatttttgagcatccacaatccagcaacctattattggggttagtcctattccttaccacttaatagccaccaccaattttaaccgagcgtatatgttcagagtctaaccatatatatatatatatatatatatatgtacattttgttcctgcttcataattgcccagagagtctatgagtgatggttgggcgtatacatggtctcagcccggtaactgacgagagcagcataaagttaggtcttgtgctgaaaggacagctggactggtccagtgggatcttcttgtcctttgcagcatgccattaggggaccagcttgccaaagaagctcctgaacatctttattcagcccagtgcttcctcgtcttaaccaagagccacacagagacaacagtgaactcacaagttcataggattccaaaatgattgactccccaagtgtctgcctgtgttggcaaagtgctctttcctttcccactgtctgcacagactgtactctggggaaactcccagcacttgtgggtgcctggttaccgaggatgtgcttggctgccatggtaactcccagcctctcagtgtggaccactctcccgcaggctcgaggagacctggcagaggccccatggggcggaggctccctagggctgctccacctgcagacagccttgggagaacccaaggtaatgtggagtaggacccagcacacaggagctccctccgcacgccaggtctggggtattcccatcctttcttcctaagatgggatgcacttaggtggccaaattgcttcttaaaaggctcttcttcaagccatcatcctcatatcacactcatgcccacactccagtcacatttgcctttaaaaaattttcaaaattatttttgtattatcccatgtaacagatgtccaaagagttgccattttcttaacactaaataaattctgcctagaagattaagattggtccagaacagggagtgttttaataagcacaaatataaacaaaagcaattttaaaatttacttatggattctttcagaaaacctgatttcaaatcagaaatactcatttttgcccccagagcaaagttccagaatactatttcttcttgaacttgccattttccatctggctttgaacttgagaatagactcccctatattggcataaaaggtaaagtggaatttaccactgaaactttcagagctcaatttagtctggccccatggaccaggcaagaataaactctgctcaccagtaacaattctgcagccaccgtactgaacacaaaccctggagaaattctggacatggtactgcttaagaatgctgggtactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaagaatgctgggaatgtcagtcgagggtctgatttcagaaagaggacattaatattcaaatccctgaaccatgcccacactgtgggagtcaggcctaacaagatcccagggtccatagtttacctggtcagcttgctgtgtctcatggggcattagagggtagatgagaactttccgcaatctcgacaactgcactgtaagaatttcttctgtgtattttctaattctgtgacaacaggcatcaacaaaacatgtggcctgttatcacatggttcctccctgtgtgcaccttcatagagattttttccttttctaaaagaatgaggattcctctgaatgttacactatgcaacaataatgtccccagtccttcataagtaacacagtaacaatataagcaccctctccctacataacacacacacatacacacaaatacacacacagacacatgcatacacacacacatacacacagacacatgcatacacacacatacagagacatgcgcatacacacacacgcatacatgcacatgcatacacacaccaagacatgcatacacacacgcatacacagagacacatgcatacacacacgtgcatacacacacagacatatgcatacacacacgcatacagacatgcatacacacacatgcatacagagacacatgcatacacacacgcatacacacacacgcatacacagagacatgcatacacacatgcatacagagacacatgcatacacgcacacagacacatgcatacacacacacgcagacacagacacatgcatacacacagagatacacgcatactcacacagacacagacacatgcatacgcacacacagatatacacacacacacacacacacacactcttatcctttccaatcagttatgagtgacaccacaaaagtaaatttccagaaatcaaagccttaagattggcgttcctcccctgcatgcactgtggcattattttaaaaatgtaccatacacttccctgaacctgcaggcaacagcctttcttccagtgtttggtaggaaccctggattcagaagaccaggttttgcccccagatgagcaatgtcgtcctgggtatatcatttcactggtcggaaatagcttcctccaccccttttttaaaaacttgataaattttattttttagagcagcattaacttcacagcaaaatagagcagaaattaccaagagctctcatttacccccggcccccgcatgcatggccgcccccacgagtgatatgccaaaccacaatggtacatctgtggaaatggatgagtctacactgagacattactatcaccccagagtccattgtttacaatggtgttgtacattctatggatttgggcaaatgtataaaggcatggatccaccattatagaatcatacaggatagtcccacggccctaaaaatcctctgtgctctcccaattcatcttgtgtcctcccaacccctggcaaccactgatctatttactgtctccatagttttgccttttccagaatggcatataattggactcatgcagtacgcagccttataaaattggcttatttcacttagtaacatgcatttaagtttccctcatatctttttatggcttgagagctcacttttttagcaccaaacactcatccattttctggatgtaccactgtttatttatccattcacctactgaaggacaccttggttgcttccaagtttggtcagttatgaataaagccactataaatatctgtatgcaggtttttgtgtggacataagttttcaattcatttgggtaaatatgatatgttaaagctatatttagtcttgcaagacacagccaaactgccttccaaagtggctgtactgttttgcattccactagcgatgaatgagggttcccgttgctccatatcttcaccagcatttagtgttgtcaatgatctgcatttgggccattctaaaagatgtacggtggtgtttcattgctgttttaatttgcaattccctaatgacatgatttgggacatatttttatatgcttgttttccatctgtacatcttctttggtgaggtgtctgttcaggtcttttgggcatttttttaaatcgggttgttttcttattgttgatttgttaaagttctttgtaaattttagataataattctttatcagatgtgtcttctgtaaatattttctcccagtccgtggcttgtcttctcattatcttgaccttgtctttttcagagcagacgcttttaattttactgaagttcagcttatcatttacttctttcatgatcatgtctttggtgttctatctaaaaatctattgccatatccaaggtcatctaagttttctcttatatgttaccttctaggagttgtatagttttgcattttacattagatctgtgaccgattttgagttaatttttgtgaaaagtgtttgttaggtctgtatttagactcttttttttttttttttttttgcctgtggatgtgcaaatgtgcagctatttcaacaccgtttgttgaaaagaccctctttgccgcactgttttgcctgtgctcctttgccaaggatcagttaactatatttgtgtgggtctgtttctcagctctccattctgttccactgatctatttgtctattccttcaccaacaccacatcgtcttgagtactgtagctttctttctccatataaactgcagactcagttttttggtaccaacaaaataacttgctgagatttttattgggattgtatttaatctacagaggaagctgggaagtgacatcttgacaatattgagtccctccatgaaatggaatatctctgtatttacttagttcttctttgatatcattcaccagttttgtagttttcctcatgtagatcttatacatattgttagatttataccttaagtacttcatttcaagggatactaatttaaataatcatgtgcttttaatttcaaatttcacttattcattgccggtatataggaaaacaattgactttgtatattaactttgaatcctaaaatcttgctataatcccttattagttccaggaaggttctggggcttgtttttgttttgttttttggtcagttatttcagattttctacatagatgatcatgtcatctgtaaacaaagacaaagttttatttcttctttcttcccaatctatatatttttatttcctttccttgtcttattgcatcagccaggacttccagtatcatgttgaaaagcagtagtgatggggacaccttttttttcctgatcttagtgagacagcttcaggtttctcaccatcacgccatttagtatgatgttagctgtaaggttttttttttagatattgtttatcaggttgaggggcttctcctctattcctgctttactgagtgtttttatcatgaaagactgtttggatttttctgcatctgttgatatgatcatgcaatttttcttcttttgcctgttgatattcattacattagttgatctttgaatgttgaaccagccttatatacctaggacaaattccacctggtcatggtgtttaattattttcatatattgttggacttgatttgctaatattttgttgaggatttctgcatctatgcttatgacaggtattggtctgtagttttcttgtaatgtctttgtctggttttggtattaaggtgatgctggattcatagaatgagttagcaagtgttctctctgcttctagcttttgaaagagattgtagataatcagtatcatttcttccttaagtctttggtagaattcaccagtgaacccatctgggccaagtgctttctggttggggaggttactaaccattgattcaaattatttaacagagatatacctattcagattgtctatttgctcttgtgtgagttttgacaaattctatttttcaaggaattggttcatttcatctacattatcaaatttgtgggtataaagtcattcataaaattccttcattatcttttattatccttttaacctccatgggattgctagtaacgtccccgctctcatttctgatagtagtaatttgtgttctttctctttttttcttagttagcatgccttgagacttatggagcttattgatcttttcaaagaatcaactttgtttctatttattttattgatttcctattttcaatttcgtgaatttttaatctaattttaattatttcttctcattggcttactttgggtttaatttgctctttttttctacttttttaaaatggaaacttaaatgattgatttcagatcttcttttgtgctatctgcattcaatgttataaatttccctttaagcattgtttttattgcatcccacaaattataataagctatgtttttattttcatttatttcaaaatattttttcacttatcttgagatttcttctttgacccatgatatttacacgtgtgttgtttaatctccaagtattttggcattttccagctacctttctgttactgatttctagcttaattccattgttatctaagagcaaacattgtaggacttgtattccttttttttttttttttttttttaagacagagtctcactctgttgcccaggctggagtagagtggcatgatcttggctcactgcaacctctgcctccggggttcaagcgattctcctgcctcagcctcccaagtagttgggactacaggtgcccaccaccaaacctggctaatttttgtatttttaatagagatggggtttcagcatgttggccaggctggtcttgaactcctgatcccaagtgatctgagaatttctattcttttaaatgtgttaaggtatgttttatgacccagaatgcagtctaacttgatgaacattccatgcaagcttaagcaaaaagactaatctgctgtagtttcctcatctttttcaacaaacatttgaaccccatagtctctgctttaataattctagtatccattccaacctacaccaccatcagttctagactgtacctctacactaaatgaccccagatggttcagctttaagtctcagctgttttcatcatttaactgattcccttgctggcagcagggaaattaactaccagccacacacttgtctccaacagcacccaccgaccacgtcctgctcccctgtcattaccaccactaaacccggtagcagagagatgagctgtgaggtaggtgccttctagataaatgaggtgctactggacatgcactgtggtcttctctgcagtagaaaaatgtccaaggaaggtcagcatcattgatagaaaataaatgtgaggctgcatctcgccagctcatccatgagcaattccttcagctccagcaggctactgacaatttgcttttaacccaaatccagctctaccctccctaaagcatgcacctagggccccagtcagaaaaacaaaacaaaaactaaaccagacaggataattaaggaggcaaaaagcttaaaccataatattttaattaagctgatttattttaaccgtagcactactgctttattttagttatataccagtaatggaaaatagtggccacttttcattattaatcataagataattcattgtatttgtctttcctaataaaatggcattatattaaggcccaaaatgtttactatggcccagtaaaatatagggttgttctgtgagctatttcttaggatagaaaattattccagaaagctattagttcaaaagtctctagcagtgccaaggtttcaatagtctctttaattttgaatctatgcgattgaagataagactgcatctagtttgggggttgcatgtttgtggacattcatgtttctatgtacctggaacttcttattctcaccatcacacagaattttcaagaactagttaagcaaagaaagcaaagcccagcaggtgtcagaattgggtccccaagctgagggtcattagggtgcatgtcagtgtgccaactccaatatccacacctagagaacgcacatcttcccaaaagaaatgaagcacagatgatacttgatcctcaactttgtctccagaaattttttcaggaacttgagttctttatcaaatgctcacatcctacagagaaataaagtgttccattttcaaggttcatgaagctcgtcaatgctgggagcaggcacacacttgtatttttatactcagggatcccaacaggcaactaaaactagacaaggacaaaactccactcaaaatattctgaaagttagctgatgccccatattttattactccaaatgtgtattcacttgcctgagtgctggccatgagcactcagtgaacacttgcagtacagtgagtgatgtccttgacaagttactatgaagactctgagaaaaagtaacatcccccactgtcctcaacaagcctgtaatcccatggctgccagcccttaccatgcaacaacactgcgctaagtgcatcgaaccacacaaaaccctgtgagaaaatactgcttcccacttcacacgtgaagtaactgagtctagttttagaaatacctaaacgaagagggacaggcacaacaaatttgctggaatgtaaagaaagtagatcagtttctgcgtaagcagtaagaaatggcctcatgaggaagaaagggacatttgccctgacatttctcaaagactgcttaggttttggagacagagatccaagggcaggcaagcacaatggttcatgcctgtaattccagcactttgagaggccaaggtgggaggattgcttgagcccaggaattcaagattagcctgtgcaacacagcaagaccccatctctattttaaaaagagagagagagatccaaaagcaaaggcatttcagtttgcaaggccagcatgggagagggtcttaaaacagaaacacacaaggtaagattgggggatggtacctagaccagcctaggatcataggatttgataaaatatgcatttggaaaactggtgctaatttatagagacttagaatttcaggctaaggacaaggactaagaaacgaatagcatgaacagtattattgataaacccatcattgcatcttaaaggctctgaagtctttagtattgaattaaaaaataattttcactggacaaaaccaaaaggtctttacacaactgtcaagcactttgaaatgattcagcaaaaagcagaataaatcactagtggaatttcaatagcatgtagttgtaaaccatcatgtgtccagcaaaatcacaaaacaagagtttattttagaagggacttagggatattaagaaatataacatacaaaataactaaagttttctccaagcaaaaccaatgatcctttagggatgaacagaaagaaaacaagaaatgcttctttcaaaagttgctaccaaggcttctaagatttctttggaataaagtcactaagatttgcttctgaggtcaatcttgccaacttttccaccatgctttttaggaaggaacaccaggtagggctcaagtactggtttggctcctgtcccattttttggtccttttgtaactccctttactcaactccaagtatgtctgtgcacggacaatgagacgaaagcatgctcaatgcgaaagcacaaattatgtattgagaaatcactacaatgccaaatttttttaaaataaaaaaaaaatatatatatatatatatatctttaagaactcgctgtgttagggaaactgtttacatattgaggtgttcctctttttttgactggaacaataaaagaaaaatttgata

SEQ ID NO: 10554 - DNA, 2161 bp, Homo sapiens
  ENST00000366621
gcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagattatgttacattaatctgagaattttaaatttagaagctaaaataaataaaaatcacagctggttgt

SEQ ID NO: 10555 - DNA, 1182 bp, Homo sapiens
  ENST00000472190
gagtcagtagaaaatggggagcctctgtgggctcctggtcctgcaccgtgataaatagcctgtcctgcaacctggcttaaaacagggaaagccggagttaggcaacagagtgcctagctttctcagtcattcaaacacaagcacggaagaagagattgcactgaccagaggaccgccagggtgtgatgctccgtagtcgcagggatgaaggaaaaccatgggcggagcttgtcatggacagctcctaggtggacataaatggaaactcattggttctggggcacggcgggaagagggagacggccctggacggccgcaccaagaatttcacaacccaaacccgactagaaagcctgggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaa

SEQ ID NO: 10556 - DNA, 2086 bp, Homo sapiens
  ENST00000366620
gataaatagcctgtcctgcaacctggcttaaaacagggaaagccggagttaggcaacagagtgcctagctttctcagtcattcaaacacaagcacggaagaagagattgcactgaccagaggaccgccagggtgtgatgctccgtagtcgcagggatgaaggaaaaccatgggcggagcttgtcatggacagctcctaggtggacataaatggaaactcattggttctggggcacggcgggaagagggagacggccctggacggccgcaccaagaatttcacaacccaaacccgactagaaagcctggggctcccaatattacaagtctgttcttgacaaggaagttgggatgacagaactactgtatgaaaactcagaaatgctcagaagtgcagacctttggttctgttttcttcctcatcagataggaattttttttaactacgcacagaatcacacttgcgaagtcttcttttccttcttgttactttatttagaagctgtgaactcaagaagtaggtcccatgttgaatctacatgtgcgcaggtgattcttttagccaagtcatttccacactcatgcccaagtctggagatacacaggtgcgggtttctgacaacatcaagatatgaaaggattttaagctcaacggttatcagctcaaaagcagaaaatgttcattcccgtttgtgccctggtatcttgaagaatgtgcaataggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 10557 - DNA, 601 bp, Homo sapiens
  ENST00000487728
gactgagaagagctaaaccccagtagagccaagttgggaggtggtgaaaaaaatccaggtgaatggggctaagaccccatacccaggaagcgagctggcatcagaagcagaagactgaggtcatttttatggatgggagatgtgctggtgggtttttagaagagctcatgtcagttggcatccatttcttcagtaaggtgagaaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgt

SEQ ID NO: 10558 - DNA, 726 bp, Homo sapiens
  ENST00000446915
gtcctgagggttttatctcctgatttggttagaagattgttgaatctggctgtgagagcctttcaagtgcctaaaggagagagcttgaacttccctgagagtacaccaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacc

SEQ ID NO: 10559 - DNA, 473 bp, Homo sapiens
  ENST00000472869
ctccttctgccttgtgagattagagtgagaagtctatgaggaagcagccctcaccagacactgaatctgctggtgccttgatcagagacttcccagccactaaaactggacagtcttcattgatgaccttactatttaccacagaagttcatctatgtggctccaaactctatttcaagaatatgaaaggcatgtaggttatgcctacgttctcggacccttgatagatgttttgctgacccaccttctgatatctgtagagttaccctaggctccaccttccaccaaccagttctgtgtcaaagtgcaaaatgaaaatcacagaaaaagtcaacctgacctgaagcttattcatcaccgtgcaatgagtttcaccatacagttatggccacaccgtgcccttgtcagatggaggtaaggccttctgcatcatctactccgtcattggcattcccttcaccctcctgttcctg

SEQ ID NO: 10560 - DNA, 7501 bp, Homo sapiens
  ENST00000340700
gcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggagcggcatctttcttggatgttttttctctacacagacttctttctttccttggtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttaaccaatgacagaagcctgctgagtttggtctttctcacaggggtaggtagtccacatgaactggcgagcagtggtgaaaacatgacatcaactgctgcgtggttaaaggccaatcatgcattttcctcagtgggtgcaatggtgacaataaactgatttggaaatgtccatgtactttggttataacttgttttgataagaggggtagaaataccaaaacaattgccttgcatgatgccagtggcttgctgttctgtctagctgatcctacatttttacaaaagtagacatcctgcatttctgagacacactgaggaggaccatggcatctttccatctcagggctttttgtcccttgggtgtcttagggtagacatagtgataagatccaatctcgctatctccaaacaaaaagaaaatgtaccccttgtacagtaagcttgaaatgtttttattgcttgcagcgtaagtgccattaattccatttaacaatgatacttagaaatatttaaaatatttcattttacttttatgtttgggcattcctttattctgaaaaagtcaccactgctccttgcttgtttctacatctcacatcggttactcactaaaactggaacaccctagactgattgttcccaggcaaacgataagctaacacatcataattatgattggtctgtgaggctagaacatcccgcagaggaaagtcggggaatggctagtcataggttgcatgatgattttaaatgggtttgtatcagaaaggggaaaatacatactcctgtgtatgcctcagtctttatcataattggctggttcacagctagctctttgggccacacgtgaaagcatttggacctggcaacaccaggcagttgctggttatgggtgttctaggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcacttatttggtttccactctgtgttatctggtacgttctttgtagcagtgtgttaaaattccaggccctacggccaaatctggcagaggcttccctctcatttatccagtgccttctgtgggccaggcacaggattaggcactttatgaacgtcagctcattgaaacttcacgacactatgtgggaagtatttgcaaacccattatatacacaaggacacagaggctcagggaagctatgttatttatccaatggcacacagcaagaaagtggtagagctggtattcaaagtctgaccaaagtctgctttcaacttcactacagtgtctgtgtcatgcatccttgtgattgtgtgtgtttgtgtgtatgtgtgtctttctagcttcatggacacagcttacagatgtggggagcagatatggtggaatctccaccaccaagagggcacaaggtctttgtgtaaacatggctcaaagggttgcccctgcagacacctactgtacatttatttggttttggaaattttgtatgtggcaccctttaaaaaatgccctttgaaagcactcttttgcactttacttgctaactttgtagaaactctgcatacagcaggaataaaatagttcaaagcactaagctgcatactctaccaaatggaacaggtgcatgtgttggtatgtgcatagatgcttccccaaatgagtcaaatcagtcacacagagggatcaaacataaccttgggctgggggtgggaaaattttctacataacccattccctgagacatttggccaagaatgtgatgaacaaaatcaaagaagatcctctatggtgattgatcgattaaatatgtgtgcaaagtgtttagaaacctatgaaatactctcgcaaagatgctgagagagaataagaggttggattcctcttcatataaactaattttggaggaggccagttggtttgaagttacttgaatgttaccttttttagatggggccaaatggcatgtagaatacacgtgataggtcaaagctgctacacattctatacatgcatcagcacagccccccctttccaatctgcactcccattccagcataaacctaggagaaatgtttcgatttcacacaaagaaagagcacacgtccaccatcttcagtgggggctgtcttttgcttcactggcaagcaggcactgaatttttcttgcatgacaaatctggaggtttactggtgagagagccaatgggcattttttcctggaaagagtacagctccatacccagtcctaacccaacagtgatatttatcactttggggcagggctgtatagagtgtgtgtgtgtgtgtgtgtgtgtgtgtgtgtgtgtgtgtgtgtgtgtgcgggttggggtggtgttgggccatctctggcctgttactaaggtaactaggactatttgtgttccagcagtcatagcctgtgattgtgggtgcatcagttctctgcctagatctcttgttaccttgtctgcacatcaagggagggagttgagcacagatacttgtcaagggccattgtagttgtgcagttctctaatgaaacactccctagtccatgagttcacaaaatttattaagattaaattataagttggatttgtgaataatgactaattaattgtcttgcccattttaggttaaggtgagagcttagtctcttgccctttgggatttgtcttttgggggattaatggagaccagatgtacttgggagactggtgtccaaattcggatcatgccctgtgtaggctctctctatcctcccttatagctctttagtgtactgtcaccgggagggctcatgctgtgagggcattttttgcatggtgttaagactagttaaagaaattttaagctgttgttatttgcagtcaattgtagtacttcatgtatcatgaattcaagtactatgatcagacagacatctctctctctctcacacacacacacacacacacacacgcacacatacacacacacacacacacctgaggaaatggctgctttgggttctataaggaccattccatgtttaaagtcctagttgagctgaatgctaagaacctgcccccttgcctccctctgagatgatatcatttcctggcttcgtcaatgctgcctgtctatttgcatgctgggttctgaggactagtgagaaggtgaccagagtttgggtggggctggtttttacccactggatttggtgagaatatgaagcatccagtgtgtaccagggtttctgaaccacgggaaaggcgtaggaaaacaaacattcagagcccctgtaaaacgagaaaggaaaaaccagccagtgttgcattccacatctctgcttgttgcattttgctaatatggggttattctttctcactgttaggatgcaattgtgtgcaaagacagtggctgagtgaacagtaagagctggctagtaatggccttaaaaagaaaaagggtaactctctgaaacaaagatcactttagtgtggcattgtggatgctgttaattctgcatagggaaactttggaacagcatgctaattacatggctgtaagcaaagccctgtcctctgtctctgcaccataccttcattggacttcaccaacccatccatactccatgtaaacctcagttctctcatgcctgccctaagtcagttgacatcagtgcagtggcattgaggagaaatgagaggtgtctctgattttactgaaagttattatcattttcacaggtgcctgagatttggtatctactttgtgttcttgattcttaggtgaaaaatctgaaatagttccctgtgcattaaaataaattattttgagaggactcctgctccgtcgattcagcagacctatgctgcagaaggtaactgcggaagctctcttttgctgtcagggctctgagcttgaagggagaaggtgcagtggtgcctagaagtgatatgcaaaccacctcacatgccagcctctggcctccttcccatcccagagtcacagacaggggacccagtgacaatgatgataaatccatgtgtggaggtgttttacttatttttctttccgtaggatttcatggtgctttaaaaaaaaaggcattttacagaaaataatgtggggggagggagatttcataatgttcttagggaaagtacaaaacaaatttgcttgtgacatttcaataagctgtgctgctattgtctttatttgatgatgtaatttttttttcaatgatggagaaaaattgcaacaaagaccttctggaagatccaatccaa

SEQ ID NO: 10561 - DNA, 2396 bp, Homo sapiens
  ENST00000312350
gcaaggcatggagcctgcactttactctgaatgttggtggcgccttcagagcattgttagcaagggtccatgtgatcacactgacacctgagagagtgacacaccatgtacatggctggtatatggaggatggatttaagggggacaggactgaaggctgtcgcagtgattcagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 10562 - DNA, 2725 bp, Homo sapiens
  ENST00000319231
gtgtgcgggtgtgtgtgtgcgggagtgtgtgcgcacacgccttcgggggctggagtgacactgcagtgggcttctccgtagccccagccttcaggctgcgcagcccctaacctgccggcaccgcttttgggaagcagcttggctcttccatctccccaagccttcctctccatcctttcatccacccctcgccgatcttactttttcttttacccacggggccgcggccggccaccccctggccggtgcaaacacccaagccctctccagttctcccccaagctaatattttcccacctgtctttttctggggttcctccacgagccagtccaaggctcccccatcctcggaaattgttttgttggactgctaaaccgaggcgtgtaaagcttgaggactttattattatttgggttcttttcatttcttccccttctgggcaacgaagcaatgaaatttccaatcgagacgccaagaaaacaggtgaactgggatcctaaagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 10563 - DNA, 548 bp, Homo sapiens
  ENST00000556282
aaccaagcgtgtctccggctgcaactccagcaagcgcgccgctgccgcctccacgcccgcccgccggccggccgagccatggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagg

SEQ ID NO: 10564 - DNA, 6227 bp, Homo sapiens
  ENST00000327876
gaaaggagcgcttccccggactcggctcggctccgaggctctgaagccgacgccgccagctcagccccgggggcgggagcaggactgcccgcacagcccgcacctaggaggcgccgatcccgaacgcctcatgggacgcccccgggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcgacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaagaaatactatttggccaggcctgatgttatcaagggcaggttttggggacgcctgtgttccttgtgagtcccctcttggagaaccgtggcccccagcagattctccttcagggagagaaaacgtggccccccaggcccacacccagggcataccgcagcgaggagggttttgcagactggcactaaaccccgtccccatgcacagaagcagccggcaaccccaaagcatatggtgcaacttttcgtggctctgaattacctcctcagcatttagaatcctggcccagcctagcagcttccttctggtcgtcagaagtgatatagtcacagttttgacaggtgggggttgggacagccatatgttgcctcccgatgtatatatatagaacagccactacacacagagaatggtgtagtattatgcaatgagatgaaacatagcaccaacttgcggactgtggcatttcccccagatttggaaattgcagtggtgaggggcttagctggcctttctcagctcagagttagtccatttagcacagagcacagggcagctacttctaatggtgggcggtccagggcacctgtgaggaggggagcggtgaggctgcaggagccctgctgggcttttagctggctgatctccaggctcggatcggcagatcttgaatcccccaaccgtcctttctttcacaagctcatccacagcagtgcttttcaatattaaccaggaatatctgagtcttctcagacaagatatttatttgttggtgtggattttttttttcttaactactgttgatcagttcaacttttccccctttaagagatcatggggttgccgggcgcagccctccagcttctcctcctcctcctctgaaggaggcacctctgccagctgcgtccttgggaaccagggcctgcagcaccaggaacccaaaagaagccatcttgcaaatgtcagggtatttggctccagaggccatgatgtgtttggggtcaggaaagatagaatccctttctaaatattgtttatcaagaggatttgtcttctccatgcacagcctattggaggcagaggaaggcaggagggaggtagctggtgaaactggtggatggaagtaatgttaggattacagttttgctctcgggctgagggacagattctcccagacttgccttctgcagcatagggggtccctgacctggaggaaggccagatacccaggcttcattgaaaggatagtggtctgggggtgtaaacgaacactctctctgcccatttttctcatatatgatgagggcaaggacaggtgccagagtttatacaggcacggcgtgacccaccagtatgcacagcttctgataggaagtcttagaaaagcaccgcctcaccgcctccagctggagccatgctgtgaaatctctctccctggcaaatgtgcgtggaacacacacacacacaaacatgcacgcatgcgctcacgcacccagcattagagtcaaacttgaatgtcaaactcttctttccccttctagttcatggcaggaagggaaagcttacctgagatctcagtgactctccagctattttgggtaatttctgatttgagttgggattggtttttaaacacaggccctaatctggggtgaagccagtgaagcagcgctggccaggagagacgtcagtcttgctaaatcctgaaggtgggttcctgtgaaaaccatgctttcaggattcactgtgactgtcaggccagcccagtgagtgccccccatccaacccatggttgcggtcacagtgaagggattgcccacgcaggggcgcacgtgttctctagggcagggccctctgacaggacctggaaataaaatccacatttatccctttaaaaaagggaacgattaaaaggcatccaattagaggtgttacctaggcaacaggaaataacttggggatcagagccatccagagagggaagaagagatccccatgatagaggcatctagacagtgaggacttgatctgcgggcaaaataacagcctacccacaggaagtgagccccagcaacagtacagcagcctaaaacccaggcatcaagactgtgtgagctagacaggtctaaagaaacctccaggcaatcccccgcccagcgtgcaggactacacagaatcgtggtctccatgggaggaaccaggacccacctccagagaagaaaaactcaaaatgtttcttggcagtcttctctgttggcggtgcttcctagactctatcctaagttgcttatgctgcagcctcagctgtttttacttgttttcctatgctttggttttggaaagaggcaattggaggcagcttgagcaatcttctaaaggaatggtaagcatggtttcaaggggcaggaaaatgagacccttcctcttcccacctcccaacttcccagagaaacgccagtcctccaaggtacaatggcagctcaggatccagtggcacatgtgtatttttgcctatgttcccctgtccccatcccccaatccagtctcagtcacactgccatgatacatcacaccatcatccttcatctcaggccaaagggctcagcgccccagacgacagggactgcttccctgaagcagggatgtggttctcccatcatttcaggaacagtgacattgatagggatgcctttctttggtgcaggttcttctgaacctcaggccaagaaagagctccattccctcagatgctgtggcctctctcactgtcttgggggtctccagtttgcacaccactggtagctcactgtagcctacaatttcctcatgctccaggatttgcttcctaaccttaggcctggacttacccatcatgccggtgctgtggggctcccttaaagtttgaatgaactccaagaggccctcaccatatgactgtggccacagagaatccagagtcttggctagcagccttctcagagctgaggagaaaggtaaagaagccaccctgggtgtcctagcttgctaaagccaggtggtcaggcctttgtgtcctctgaatgaagcagtgcctccaggcctggagaaggcatcagaaggcttaggcaatctcaggctctcattttgtggaaaatgccagacagccctgggcatttgcacagcatcatgcatatatgtatatatatatacacacacacatacacaccagccttacaaagagctactaacccttttccccaaggaaaagtctcagtctgggccactttaagaagaaagatttcccatttttaactctctagagatgtaccagggcctggaaaatccctctctgccttgggggagttttatgtacaatttgcatgtattcaggtttcacacagaagccagcatccaaacccaagccaaaccctggaaaatagctgctaaattgacccaggatcctccgtccttcagacaggcctcccagcagaccccctcttcctgtggactctggggtgagggatgactgagccctcatggccaaaggagaagcttctggggaactgaggcagacggcagcccagtcaggcagagaccataggagcgacgggccctgtggttcgatcttactgtaactttttacattcttaaaaaacaaaaagcacaattccacatacacactgtctggaaagcacagccagacagccagcctagggcatctgagtccagaagaggcgctggggctttatctgttgcagggttcttgtattgttgtataatgtgctggtggtgactcaaggctcctcactttgtagggtggagagggagggagggagggcctgctgaggccattcctgacccccagggtgggctcatcagcatggacttggggcctggactcttgcccctgaagcagctctggcactttcaggcaccccagagcacaattgctacaccttccacgctagtctcatgcattgaggatttctgcactcggacctggccccaaaccctcttccccttccccttcttccctaaggaagctcccccttgctttacaaatcattttttatgctatctgttctctcaggagggggctagagcatgcgggacaagcctgcagggtttctcaaacaatacatctatttttctgagcagcattccaagagaggacttgaagggtgtttaaattaacgatgaataaaatgcagcctgcc

SEQ ID NO: 10565 - DNA, 833 bp, Homo sapiens
  ENST00000493527
cccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccatagatctccagaattatagtgacagtggggagaaggagggaatgacccatcccccatcccgagcttgctagcccagctcctggaagatcagcccctgggcagtgccagcctgcatgaccgtcctgatccccgactctgccctttctgccaaagagccagcagagcacatgtctcggagaagaccccctatcaccttctaggttgtcttgccacagaacaggagcacccagcaatacagcagagcttcccacgggtttctacagtgtcttcagagaaccgcaaggagggtcagcccttgtggagtctctgacccaaattctgacattacctctatgacttattcacaaagtgacctcacactgcacttttctgagcctcagattgtgcatctaaaaaccgaggataatgcttacctcactaggtggttgtgaagaaatgtaaataaaccgtgtgtgaaaatg

SEQ ID NO: 10566 - DNA, 2522 bp, Homo sapiens
  ENST00000282146
cgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 10567 - DNA, 6162 bp, Homo sapiens
  ENST00000302909
tgcccggcgcggagagcggcgagcgcagccatgccccaggccgcctccggggcagcagcagcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaatttgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacgtgggacctgaaggtgccctctgtgtttatgttgggggtgggggggcagtgctggctgcctctgtcctgtgtgtgaccctgccctcgaagggtcctgtcctgtcagtcccgagggagccacaaccaaagctgcggagagaaggtggggaagggtgcagaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacggagaccaggctcaggctccagctgcctctgtcatcgtatgcccttgctgctgccagggaggggccatctcccaccccctcccctgccggggtctacaaacatatctagctgctgggtgccgtggctcacacctatagtcacagcactaggcgggcagatcacctgaggtcagaagttcaagaccagcctggccaacatggtaaaaccccgtctctactaaaaatacaaaaattagctgagcgtggtggcgcatgtctgtagtcccagctactcggctactcaggaggctgacgcacgagaatcgcttgaacccgggaggcggaggttgcagtgagctgagatcgtgccactgcactccagcctgagcgacagagtgagaccctgtctaaaaaaaaacaataataataaaataaaataacatacctagctgactcgccatgggctcgctggcctgtgggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggactggggattgctattccagtgctccccatcctcacacagactgcacagtccgcctggacacaccccagctgacagtggtacctcccagtcagccaggagaatggattccttctcctgcagtaggggccccctggctgagtggcctgattgactaaaacatatgtctttgaaggagagtgcatcacaagcacctttctttggggtagatttttctctgggtctagagggacagctcaggcttgggactgggcctcagaacctacgacagaccgtgagagcagacccaccttatccatctggtgccagctccccaggtcagctacagcgacccccggacttcatagagtacaatccacagtaatagcacacagctctgtacctatctagctccatgcctatctatctgcctacctttcacaaaataattcttagcaaccctgctacagccaatgattctaatacgttctgttctattgcatgttataaaatgctggtcacgatccactaaattgatgtctctacctgctaatggtttaatacctgcagattgaaatatactggagaaataaagagagtgggagtagggacactttctcccagtgcccacaccgcccctcgttacccgcataggtcaactgaaagatacagagagggaagctttgatggggggttcagagttcaaaggaagaaatgatggcacctgcactccctgcccccagaggcaggacacagccagccctcctgtgacagcactcctggcagctccttgttggcctgcagccctcagggggcttagttgccattgactcacccactcctaaggccaccacatcaaaatctgaggcttactgccctgtcccacctgcctctgtctttcttaaaacagctaaatgcaacaatagcagaaattagcttgtttttgaggttggcaatgaccagttcaaggtgactcttattttcttaagcagtgcttgcaggacataaatgtgatgacacttgccctcctttctttatcgcctgggacagactttacaaacagacctgggagaagtcccctaaggggctgcatttatccccatctccctaggggtgatcagcattgtgacagctgggcagagcagtggtgaactgcacccatgtccctgctcacatctcctaagatctcagaattgcctgaggttctagcgtgggctccttctctccagatgatgccatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcgttggtcaaatgaatttgggaaaatgctgtcaatatcaccgactcatggagcttcgcaaggcatcttagcttaataaaggttatgaaaagtcttgcagcaaa

SEQ ID NO: 10568 - DNA, 1956 bp, Homo sapiens
  ENST00000620977
tggtgctgaagggacagctccgcggcggcggcggcggcggcggccccgggcgctgagcgggtgcccggcgcggagagcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttca

SEQ ID NO: 10569 - DNA, 11400 bp, Homo sapiens
  ENST00000604624
ggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaac

SEQ ID NO: 10570 - DNA, 11920 bp, Homo sapiens
  ENST00000639601
ggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaa

SEQ ID NO: 10571 - DNA, 11990 bp, Homo sapiens
  ENST00000638991
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaa

SEQ ID NO: 10572 - DNA, 12071 bp, Homo sapiens
  ENST00000639913
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctgggaagaaagaaaaaaaagaaaaagatataataagcagtattttaaaataccatgagttatgggcatgcatatggtacaaagagtagttctttgggttgaaagaaagaagagtttgcattgaactgcgtaggctggcaagaatgcagaggtatacaatgtttgatgggctttggaggcatttcaatagtaaatgggtgacaggactggaaagatgtggaatatgagggttttccagggagatgggacttaatgggccatgatgtatttgtaggaatgtgatttcaatagattgactattttgtctactgtgataagtttgtgtaggggaactgaggaaaactgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttctaaaa

SEQ ID NO: 10573 - DNA, 8394 bp, Homo sapiens
  ENST00000639205
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctg

SEQ ID NO: 10574 - DNA, 8850 bp, Homo sapiens
  ENST00000639486
ggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaacttgttacaacaatttaaaaataataataacaaaaggaaagcaacgaatgcacttcatatagactgttagaaaaggcctttgaaaattaccagcagtgaaatcaaataaattagccactttaaactgcggtcaaaagatttttctagccatcagatgcaattacgatgtctcagagctctgctatcgcttgcatgctcggtgtacagtctcccggcaactgttttgttccaatcaacttagcaagtctttcaactttaaaattatcaatctttgatatgatcatcaaggtctctggagaagcatggatgtaatagtgatttctattttcttaaaaaatgtaaactgtggacacttaatggaaccaagctaaccaaagtatctccccgaagtttcatgatatctagtccattaactctttgggccatgacctgtggtacctagttatggtagtgcaaatcagatcagagcaaagcaatgagatcatcatgaagacatatgtccactaagtactccaattaccagcgtaggcaaaatgagcttccacctctgtccactccctgcagagccaatatagtcgtgcttccacctcgtaggcattgtcctgcagtgatttgtcggactgtggttactctgtcgtcacattttgtagaattagttctataaaagtattgtgaatacaatgtatgtccaattggattgtttaaaaactacttataattaatcactagcctactcagcagactaaaatgatgtcaacagtctatattcaggcttataaacatttcttggtttccaacagaagtcaaatgtgtttgtggggagaacgttttgctaggattttgacaactttcctgaaagctaggccttttttacataatgattttgcattggggtcaccttagtatattcacgtcaatccacgctcttctttccttcgtgaaccatagtgggctcttcactcctgctcgtaataaccacctccaaatttgttagagtgatttggtctcctctggcaggctgtggtggccacataaaggatcttccattagagggacacaggacacaaagctccattcccatgaccctctcttccctgtgtctcccctaacaaggcaatctggaagcagaaatgcaaactccagccccaccacacatccaccgatgcatttgtggctagaaattttaatctaaactttttttaaaaaaaatcataatagttaggatagtttcctatagcaaagggctccttgattcataagcacctcccccccaaaaaaaccaaattggtaaaaattcattttcttttaaatagagcaataagttcatactgtgttgccgttgtaataatgaattgttctggactagaaaacaaaatgaggcattttgttaagggggtaggaaaatgactgattgttgggccctttggcaaaagctggtgcctggtaagtagaaacgaaatggaaacagaaataacatttgtgaaatcactggagggctcaagcaaatgccagagcttctccctggcttgttcctacttgttgagctctttggccctgagtcccatccatctccactgcaacagtctgtctttctgcctacatccgcctgagaccaaggagggtctttggtacagtccacattatgaggctctgatttcctatcccagtttagggctccagaaaagccattctcccaaactaatgattcttgggtgctgtgggtcaccaacaggctgtttacaaagcagaaaatatcatcaccatcataacctttctccttgagaaaacttttatttttgtctaagcaattttatattttagaatatcatcttgaaccattataaaacaccttaaataaaagtgattgtgactaaggcacgttggagaacattccaatctttcctcccaagggttctggcaccttatgatgtactttgtaaaaaaattgattgaagattttaaataaacaggaaattagaagtgttagggttagataaaggaaaagtgaaaaagcataagaaatttgggactttttcatgttgaaaggagaaaaagcacaagttccctagttaccatttaatatgagggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgtccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagttaatcccttcatctctatgccatgtctccaattcctagtatgtaactagaggttcaagagaccccaaattcctgccattttccccatttatgtttccccatgtgaatcttcaggaagtaaccagtcttccttctcacttcatttcctgtcctctgtttatttggttattttctttcattaataaactaaccatctcttagctacttacattcacaaatgtaattttaatctattgtgtttcattgtgaaagagaatctcattgaaggaaggaaggaagaaattgaggaataaaggtaggaagggagagaaacaaagactatccaaccaattgactgagatgtgagccggcttgactcctaggagactaagtagatccattcagcttgaacactgagttccagggcagaatctgtccattttctgttttgttcttacttgctgcttttggaatggtggtaaagccaccagtcaccatgagccttgaaaggaccttcactaatgaggacttgactcaccctctttaaaaagcaaaagaaacagaatttacttacaatcttctggtaaattacctttctgatcctctccttattcccaaaaggcaatttttttaatccagcagagatgatttagcatataaatcccaggtcatttgaggaggtgatgacgctatttggatttatttatgagacagtagtaattataaatgattcctaggcagtttgtactagtttggtcatattggttgtttaagtggagtctcttctgattgtttgtttccaataaagtatcagttgttaataatttcaagatttccataaaaataagaaaacttggaaaacatttttaattttatttcttaagagaccacagagcctaattttcaatttttatggtaagcttgcttaaaacatgtataaaaagaagcctacatgctcaaaggcagaggcacctttagccctacaacagttggaagctccatgatatcacagccccacatggatagattggagaaagaattctgacttagaccacctgtagcagaccttcctcttttggcatatttttttaatcacaaaaaggacctgagactccctatctaaagataagccaaacttggggtatacattaagaatctg

SEQ ID NO: 10575 - DNA, 4711 bp, Homo sapiens
  ENST00000639498
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttatttagttgctggggccaaacacatgaactt

SEQ ID NO: 10576 - DNA, 5425 bp, Homo sapiens
  ENST00000640523
gcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtggagactcctacgtgctgttatgcttctcattttatatttccaaaccacctgagcgagtaatgtcaacttcgggagggtctggtggactttctccccactccccaagtctcagagcttttagcctggaagtttgtaaaactgattagtagttttactttaccataggatgtgagagggcagtcattcttctcactgagtttttgtttaaaaaccaggaaatttctacaatcatggagacagattttaatttgcatgctctcctttattt

SEQ ID NO: 10577 - DNA, 5059 bp, Homo sapiens
  ENST00000372443
gcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacacca

SEQ ID NO: 10578 - DNA, 4340 bp, Homo sapiens
  ENST00000638223
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacacc

SEQ ID NO: 10579 - DNA, 4073 bp, Homo sapiens
  ENST00000639344
cttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggaca

SEQ ID NO: 10580 - DNA, 4423 bp, Homo sapiens
  ENST00000638848
gctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatc

SEQ ID NO: 10581 - DNA, 4319 bp, Homo sapiens
  ENST00000639090
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatc

SEQ ID NO: 10582 - DNA, 4302 bp, Homo sapiens
  ENST00000639489
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatc

SEQ ID NO: 10583 - DNA, 3899 bp, Homo sapiens
  ENST00000639069
gggggaaaatatatatttgcctggagaacacaccagtctggaaaagtgaagccagccaggttcagtgtgggtggagtctcccaccagggatcccaccctagcactaaccagggttgaggtgctggggaaaatgaaaagcattggtgtctttctgacccacctaggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagta

SEQ ID NO: 10584 - DNA, 4098 bp, Homo sapiens
  ENST00000639657
gaagactgtattatattccatggggtcagctagagaaaatctgtgataactttgttgaaaatgaaatacactttggatttttttttgcaagaattaaaaaaaggaacaataacccacatgcattgagccttctatacatcatctctcttaattctctaaagattattgttaccattatccacctcttgtaggtaagaaagttgagttctagggatatttagtaactggcccaaagtcaaacagctattaagtggtagtgttggaatttggacccaaattctgattgcagagccagggcatgtaaaaactgccttgcaggaaaggaggttaaaaaaatgtgcaaaatttataatcctgcctttctaaaacatcatactgaattggctttgaaagataaattcatctaaactgtatgagctctaacacttcaccctcgtgattgcatgaagtcagagggcttgttatacccatgtgaagagttggcggaggggtcattaggaggtgcttatggagagccgctgctcagtgcaggccgtgctattagtgtggactgctgctgtctgatttgggaggaatctcactgctgcctgtggttgtagggcagaacagttaaatcttcatagccttttggtattattgagtgttaataatagtcatgacacaagtacagtttcctcctgtcaggtattgttataagtaatggtagatgttcttgtgaccacaaaaaattattttgcaataatgatctgctcggaggtctcccaaccaggtgaacaaaggttcacctgggtccttcctgtatgactacagacgtatcacttcatgaccacaacacttctctggaatggtttatcagtaggaaaaaagattatgtgttaattaccatcctctatattttgattgtttggggcagctgagaacttcctttagactgattccaaatatctattaccttattaagcaacatcttttcagaacaaggaatacctctgttgtatctgttgttttattcagaatccctgaattcagtatccattaagcctgaagtcttttctcagtctctgcatcagacaatcttgtattctgcttttgatctgcagaaaattaaacttgtttgtttcatccatttattagattaggatacatttatctcttctgtcagtccaaacacaacttggtccgctaatctatttatgccactttgaaataggacaatgtatatttaggttcccacttctctgcagggcaagtttttttaaggggaggtttgcatttgttttctcaatttgcctcaattaggacatgctagacacacatcttattcaaacaccctgtacgtttttataaacagcagactggaattgttaagtatatccaactgctgacttaaaaaaaaaaactgtttgggtaaatccaattcttcctataaaggctgtacatggaatcaatttccatgtccttatcaatgtcatgaagacgttcagcttgcttccgcattggttacgggtgtcttgtaccattccctgcggtaatatgtggtgtgtgtacatgatgtttatgtatatctataggggtcccattaatgctctgtcatttaatggaaaattgttgtagcaatagcttcatcaggccaataatgcttccgtgttgaccaccaatagcagtttcaaaaggaatttattctgatggactttgcttcaaatcatgtgcccatgatggcagctagactgctccattatataaacccaggccctaataccttgatttgctttgatttcctcaactgggagcatgccagcctgggaagtaagcagtagtgcttaatgatggcattatccaactaaatgtatggggcagtggacattggactctggacaaaatctttggggaaagctttagactagtgggccccctataaacacaacagtatggtgtagccttcaaggttttattcagaacatgacctcacaaatgtatcttctctgtttgtttttgttcactgagcagtatattaattaatcctggaaaccatcttaagatccaagaaggtactttaggatttttcatcgcaagtgatgccaaagaagttaaaagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaaca

SEQ ID NO: 10585 - DNA, 3805 bp, Homo sapiens
  ENST00000372408
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaa

SEQ ID NO: 10586 - DNA, 3464 bp, Homo sapiens
  ENST00000639995
gtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatcttt

SEQ ID NO: 10587 - DNA, 4021 bp, Homo sapiens
  ENST00000639483
ggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatcttt

SEQ ID NO: 10588 - DNA, 3145 bp, Homo sapiens
  ENST00000639691
ggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgttgggaagaacattgttctttgtggagactggaaagcaagggaaatgtgagaagattaaactactgcaggggtcagcaaactttctctgtcaaagtcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatct

SEQ ID NO: 10589 - DNA, 631 bp, Homo sapiens
  ENST00000638512
atcttgtgatgtatatctgggattgtccgaaaattatgaaatgaaagttgcatcacacttcatgaaacctcttgcggttgggctacttgaaagtgactttgaccttgtatagaaaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatc

SEQ ID NO: 10590 - DNA, 3806 bp, Homo sapiens
  ENST00000372421
gcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaag

SEQ ID NO: 10591 - DNA, 3487 bp, Homo sapiens
  ENST00000640570
ggagaacacaccagtctggaaaagtgaagccagccaggttcagtgtgggtggagtctcccaccagggatcccaccctagcactaaccagggttgaggtgctggggaaaatgaaaagcattggtgtctttctgacccacctaggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccag

SEQ ID NO: 10592 - DNA, 3751 bp, Homo sapiens
  ENST00000372437
cccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatgg

SEQ ID NO: 10593 - DNA, 3684 bp, Homo sapiens
  ENST00000638895
cggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10594 - DNA, 3976 bp, Homo sapiens
  ENST00000457953
cgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10595 - DNA, 4014 bp, Homo sapiens
  ENST00000404771
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10596 - DNA, 3849 bp, Homo sapiens
  ENST00000638351
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10597 - DNA, 3849 bp, Homo sapiens
  ENST00000372440
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10598 - DNA, 3811 bp, Homo sapiens
  ENST00000638306
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10599 - DNA, 3852 bp, Homo sapiens
  ENST00000640182
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10600 - DNA, 3852 bp, Homo sapiens
  ENST00000638606
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10601 - DNA, 3888 bp, Homo sapiens
  ENST00000639591
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10602 - DNA, 3864 bp, Homo sapiens
  ENST00000640605
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10603 - DNA, 3840 bp, Homo sapiens
  ENST00000638203
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacca

SEQ ID NO: 10604 - DNA, 4126 bp, Homo sapiens
  ENST00000639968
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagacc

SEQ ID NO: 10605 - DNA, 3579 bp, Homo sapiens
  ENST00000372403
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttga

SEQ ID NO: 10606 - DNA, 3348 bp, Homo sapiens
  ENST00000640626
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttga

SEQ ID NO: 10607 - DNA, 3866 bp, Homo sapiens
  ENST00000639851
agctgaagaggggagagagacaccctccccacccccatatgaggatggtctgtgatgatatgcatgcaggggaagggacttatccaaggtccctgatagatagggactggaattttggcagtgtcttttctagagtagaacaaatttatcagttgaatttgctgtagttctctgaaggtttctttggccacattagaatttttgagccctggcatccaagtaggccaacttcaaaatggctgtgtgctccactcagagattctgctgtgaagactggcaggagattttttagcctattctgaactccaactgttccagttcctcttgctttccagaggtgtgagcacctggaagcccctgctctggtctacaccccaggctcaagattcatcctgctcactcagccactcatgctgtcaccagtgataaaactgagatgcattccccagaaccaagcaaacaagaagaaggtcctccttcagtgggctgtcatcgatcattccccgttccatggccacaggactgactgctgatgaaatctaaaagaccagcttgcagaaggcatggaaatcctggggttaggggcccctctgctatggaggttgtcttagtctttgctctcagcatcggtgcacttgtaatatacttcatagattcatcaaactcctggagacttcatggcaaaccaacatattgaatgcaggaaattccagggtggccaagaatattctccagaaatcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcag

SEQ ID NO: 10608 - DNA, 439 bp, Homo sapiens
  ENST00000468471
ggagacactctgtcatggtaaacaaagatcttgtgatgtatatctgggattgtccgaaaattatgaaatgaaagttgcatcacacttcatgaaacctcttgcggttgggctacttgaaagtgactttgaccttgtatagaaaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagt

SEQ ID NO: 10609 - DNA, 3528 bp, Homo sapiens
  ENST00000640934
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10610 - DNA, 3537 bp, Homo sapiens
  ENST00000640029
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10611 - DNA, 3429 bp, Homo sapiens
  ENST00000404857
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10612 - DNA, 3434 bp, Homo sapiens
  ENST00000640093
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10613 - DNA, 3360 bp, Homo sapiens
  ENST00000638252
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10614 - DNA, 3711 bp, Homo sapiens
  ENST00000639544
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10615 - DNA, 3387 bp, Homo sapiens
  ENST00000640807
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatga

SEQ ID NO: 10616 - DNA, 4055 bp, Homo sapiens
  ENST00000434208
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtcttccttcacttcccccattgccaccccccaatcccagtccccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatccgaagtgcgtttt

SEQ ID NO: 10617 - DNA, 6194 bp, Homo sapiens
  ENST00000286627
gggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttattctgtta

SEQ ID NO: 10618 - DNA, 6233 bp, Homo sapiens
  ENST00000286628
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttta

SEQ ID NO: 10619 - DNA, 3408 bp, Homo sapiens
  ENST00000638283
gaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaaggtatgacaattaatggttctgcatgacctagccactgctgggggttttcttctataacgttgtcc

SEQ ID NO: 10620 - DNA, 2962 bp, Homo sapiens
  ENST00000639730
tacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaaggtatgacaattaatggttctgcatgacctagccactgctgggggttttcttctat

SEQ ID NO: 10621 - DNA, 3624 bp, Homo sapiens
  ENST00000639370
gagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaaggtatgacaattaatggttctgcatgacctagccactgctgggggttttcttctat

SEQ ID NO: 10622 - DNA, 3790 bp, Homo sapiens
  ENST00000639716
actgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataac

SEQ ID NO: 10623 - DNA, 5705 bp, Homo sapiens
  ENST00000640141
cccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatata

SEQ ID NO: 10624 - DNA, 5069 bp, Homo sapiens
  ENST00000638754
gaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaaagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaacta

SEQ ID NO: 10625 - DNA, 9904 bp, Homo sapiens
  ENST00000638632
ggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactaggtaggggtcaatgtcagctttggggggagtttttgttctgtctttcaaaccatacaggatatgaggaggttggtttatttcttagccctttcaactttgtagctgctatggggtttgttttgagggggctgggaggaaggtatggggagaaatatggcagattaccggaagggaaaactgatctatctttcttctgagatgaatagacagtttccttcatgctggtcactgttttcaaaggagcatgagatgatggatttgcgattggggcattcaattgggaatggagaggaaaggaggaaaggcttagttcacggattctttctggtgatttttactgtaagaacctcttttgagcattctgtctggacagctcctacaatctgagtcctccactgatatacaaagcctcggatctaagccaaacccattttgggaacaaggtagaagccctgggctaatgtgtaataacttgacatttaacgtatcgtagttgaatatctcagccaaaagccattttcagcaaatgccattctggcccccaaaatgatggggttttgagggccatgttggttggacaatagaatctaacttctaacctggccatggcactccctgttaccattagtgagtgtgcaaaactgtagagtggcctcttcccccaagacaaatgcaaactacctgtggtccggggtccctttacttgagaatgtttcctctgttattccctcactctcttctttttctgtactttcctccactccctttccccaacccttaaatgctgtatccaattagctaaaccgggcaagttgcctttggtatcagtcaatcaggaaaaaaacagtgggacgcacattctaatgataactgaactgggtaagaagcactgttttccttcacatcagtatctccttttgttctgttgttggtgtttccaactatcatcagcttgtttttatttcaccggctgtaacagaaaggctaccccatggcactgctttgaatgtgttttatttgtggctctggttggaatcgactgtcttgttctggcctttcttaatgattttttccccacacagcatcagtaaacctttgatcacacccatctgacctggcagttgtttccaaagcatatttgctctaattcattttctctggcctgagccttttttccccacttttttttgtcaccccgctctcccgccttctcccttctactcctcttccaacatactgtcagtttgaatgacatgtcttcacagctcttagaggaagtcaaaggagaatatcaaaattttaagataagaaacctaagatggcactttccctccagctgtttatttttctttattctgactttatttgccttttttttttttcccccctactagggcatttctcagaagctctggttctgaagccataaaaacacctggtccctaggagaactttttttactaaaggcagatttcaagaagggtgcggaggataaggttagcagccacccacgtgcagccctgcactctggcccccaatcccagcccagaatcctctctgggagattcacaatggactcaggtggacgataaaggcctccagtcgtgactgcatttgttaggttcttccccacttccccgtgacttggttaataactccatgaagggcacccatcagcagcaagtctcagaactggggattgatcttctaaatagagacagcaaaagtgctgctcagcagaggggtggatagagaggtgggagcacctgccttcacatgactcacaaatgaaatgaacaccccattttcttggcccaaaaatatatttcaaaataagggagcaggctttcaacacagtaatcttgcttgcgagatgtctagaaaccaaggaataaattgtccaccactcagcagtgcattattgtaggtatagctatttatcaggacaaattcactcaggtcagggagtatcacactattttctgtttccaaccataggaggggtatctttttcatgtttagtgtagttgtttaaaagccctaggtttctggattgctctcctcagaactggagggcaataagagacccagggctcatgtggtccacgcctctggttggaaaattaatccaaacatctccatctcacaaacctacagcagcatttcagaatcctcactgccgggaatttcattttctatttggaattcacgtgccgctgactaactaggatatcttaatttgtcattagtagacgagaaaaggaaaagcttggtgccccaaacctaaggcaacaattctggtatttgattagcatcattgactctcctgaagcctttgtcccacaccagatttcttccttgtgttcagagaatctttcaggtgctcacaccacccttgtcttctgccttgaaacctatttctctagccactataccaccctcctcagaccatttcacctcccacatcccccacaaatacttcttatttatctacatgttctgagatgtgttctgcattatgccaggccagtataatgaattttaagagacacagagggcaccaaggccacacaagctttcaaagctgtgtagcacattccacttttcatctacttggagactctcaattgatgttagcatggcaaaggctcctcagagtctcacaagaaaggactgtgttacagctgtttcacctgactattccaattgtatttgaccacatatgctttggggtgattacgtgggtacctcttagcacccacataattactgttctgtgaaataggccttgagtagcattgcttgctctccttctgagactgggtatttcagaacggtatacaaggtattcactggaccctggctggtctcttggagcgcttttcctatgaccccagatgtctagctcactggcaatcgggagtcccctccccctacttggagtcacttcacctccatatctggtaccaacccttccccatcttcctgataagaggtaacagatgctgtgcttttcggagcattgccacacacaccattggtggctattacaagtaactaaaactgcattcttccatatgtggtctccagtttacattttctgattcacaaaacagaaagactaaacagtggcctacaacatccctttggacaagtgaagggaggtgaggaaaagctacctcttgaaagacccctgagcaagaccttcagtgtttccaagagaggcagagggaagctgggtattttcatgctataatgggtggacaggtatttaatgtcagaagggagatcatgacagcagctggtatttatcaagtcatggcatgatccagatgctgggccaggcttactgggcaccatcccattcgtatgagcctcctgacagcctcatgagagagctgctgtaactcccccattttacagaaacaaactaaggtatagaatgatgaaatgctttgcccaaggaagttggcagcacaggctggactgaagcccagttgtcagagcctggattttggactttcaccactagcctgcaattcaattgctgcttaaacaatggggacccaaatgtgaccaattttggaagaacagagcaaagattttccccattagaatttttctctggggaaacaagatgatgtcattttaaaatactaattccatgcctagcctttcatgctagtatcatttattctgcttcatacagtaaacaaaagttttttttttttaaaaaagaagagttatcaagaaagttgcttaaaaattaaaacaatcactctagaaaaaagaattagctgttgatacatttagaaaggaatcagggaaaggaaacctcatctgttctcttcctaaaatcacaataattatttcagaaattttgagtgcccccttctcccatccccccaccgacttttcccctattacttgctctgcaaaactgataatttccaaagccaagatgggaatggaaattaatttgtcatttaatttttaataagttaaagacatctgagtgacacaactaatcagcctgcacgtacatgcgggaggagtccttgaggaatcctcagatggaaatgaaatacagcatccaatgctgcatctgcttgaatgcaagcatataaaagattgagctgtttaggatgggaaagggagaacgtgggcgtccccatgcaactcaaaattcagagcaagtccttgtcagcaagcagcaggagacagccaggcatccatcccacctggggtttcctgtgtattaaacagggcctattgggtgtggacctagatttagggcctgggaccccgggaactacccaggccaatcccagtgggtaggctgcgggttatgcctgtggctgaattccttgctatctgcctttgctgtgctccccttccagcgctctttactcccaataagctgctttcttttcattgtggctaaaatgactatcccagcatggctgctcatcattgaaatatgtccatctctcaaaggacttggttaccaaaaaacactggaaagtgtttttaggtcatgatcctaaagctatgccaaaggactggccagcacagtctattggtcctccagtggcctgccgtggagcaagcctgcttgaacttattgctctccaggtctcagacacttaaacagtgacacaggaacagtccattgagtcccactgccccccttacccaaagatccatctacagcttattccatgcttttgtttccttctcaatgacttcagtatttctaaaccagtagcctggtctccctctggcttcaatgcctgtgtgtggtcttcagagctaattcttattttatgctttttctagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaac

SEQ ID NO: 10626 - DNA, 5789 bp, Homo sapiens
  ENST00000640969
acagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatata

SEQ ID NO: 10627 - DNA, 4939 bp, Homo sapiens
  ENST00000638751
gaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaagtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatat

SEQ ID NO: 10628 - DNA, 5567 bp, Homo sapiens
  ENST00000639406
gctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcag

SEQ ID NO: 10629 - DNA, 3638 bp, Homo sapiens
  ENST00000639823
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaa

SEQ ID NO: 10630 - DNA, 3664 bp, Homo sapiens
  ENST00000640834
cagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggcaatgtttgcccgctacgtgcccgaaattgctgctctcatcctgagtcggaataaattcggcgggacttttaacaaacatggaggcagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactg

SEQ ID NO: 10631 - DNA, 3660 bp, Homo sapiens
  ENST00000626620
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctggtcacaggctggatgccgtatctgggacctagggttttaatgacttgcctggatattggtgtagtatgcatgccaactgatattcaatcaacatctcctgccagcataaaaaagtttaaggagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 10632 - DNA, 3723 bp, Homo sapiens
  ENST00000638759
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 10633 - DNA, 3720 bp, Homo sapiens
  ENST00000638575
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgttgggaagaacattgttctttgtggagactggaaagcaagggaaatgtgagaagattaaactactgcaggggtcagcaaactttctctgtcaaagtcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 10634 - DNA, 2527 bp, Homo sapiens
  ENST00000638999
gatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccac

SEQ ID NO: 10635 - DNA, 3711 bp, Homo sapiens
  ENST00000638514
gcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggggaggaaaccaagactccagggtggagtgattggctgtatgtttcacctgcagccacgcgaggcccagaagtcttccagtgctttggaggttcacaagaaatatggtgactcaactggaaccacattagaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccac

SEQ ID NO: 10636 - DNA, 2890 bp, Homo sapiens
  ENST00000640353
ggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaaagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatcc

SEQ ID NO: 10637 - DNA, 3481 bp, Homo sapiens
  ENST00000640773
gagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatatttcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatcc

SEQ ID NO: 10638 - DNA, 2312 bp, Homo sapiens
  ENST00000639321
caggctaatacatctgcaaagcttattagtgggtgtctttgggcaagagcagtagagtgtgctgtggtgtttctaagtgaagcttcacattgcttagcaatctgtgtggtttagacatttggaaaacagcttttggtttccaatcccctgtgctgccctccatccctgccccgctgctgcatcatcagagatttcattcaatggcaacctcctccttcattccggggctctcctccaacctcaccagccccggtgctcctgtcttcatgggttgaaaaaggaccccgttggcacagccccacaagccctccctcctggcagttggagggataagagctgagttgggctggggattattgagccagcatgcaccaatgtgccccgatctgattgaaacattggctgtcaaggccttgaatccttgcctcttttcaacgctctttctctggtatgcaggggttaggaaccagctaagttggttcatctggagaagcagcaggctggcagttatgctgacatttcaaatacaactttatttctgattttggttacaacaaaacgcagtctattactgggcaaagcaaagtaaccaaaattaactctaagaataatgataagtattttttttggtatacagataaatcatgatttcttttttttttttttttttcttatggcagggtgtttacaaactgttttagtctgtttaaagtgtatgttcaaaggctggagtgtaaagaggtgttgccttcaccttctctaagccggcctctttgactaacacatttggtctttgtcattgggtcctaaaagacagccatgaattcctagtgagtgactgagccttgagtgtgtgtcctttgatattttgcctgtattgcacagtctgccctcaaactgttcataatctcatgagctgcctgtatttccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcc

SEQ ID NO: 10639 - DNA, 1515 bp, Homo sapiens
  ENST00000638370
gaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgattctgctgccccacagctctgctcctggatgcctgcatggaaaaatcaaggagagccatcatctgggatgcagtgccagctcagagagcagacaattatgctcagagatatgagtggtcccagagttgttcagacacctgtgaaaccctgggactgactatgaaattgtacctgttgatgagcaattctaaaagtcatgcactctttgactttcacacaatttcaggctaaaccaaggcccaacgattagtaggtgctcaataaatgtcagtgactgatcaaaaagatttgggtataactgatttcaacacagaagtgggaacatgttagggtcaaatcccaaagatttgacaaaacaataacctcccagcctgaccttctagatttatcattgcaatggataacctatagtgccctttgtttaaaaaaaattgactgtgtttttattagaacagttattcatacttcttgatgaaaatttggaaagcacagaaacatataaaagaagacatataaagaagaaacatataaaaata

SEQ ID NO: 10640 - DNA, 580 bp, Homo sapiens
  ENST00000638361
atatcttcatgtggcttccgcagcatgaaggcaagtgaaaatgccatagatggaggtgtattgtaattagccaaaatgtaggttaaataagagcttgtaaatttgcatcgtcatgaggtagtggcccactacttcaacacgtttgtctttcatgaaattgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttcc

SEQ ID NO: 10641 - DNA, 681 bp, Homo sapiens
  ENST00000484507
agtcttcaattttgtctggtatctgagccctgcctctggaatcaagtcctgcctcctacctcagtcccatggagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaa

SEQ ID NO: 10642 - DNA, 1643 bp, Homo sapiens
  ENST00000637862
gcctttctgatgtggctgcgtgcatccagtgcccagagcatgccggggttcttgcaagagggactggagggtgagggaggagagagtgtctattggctccaccaggacatagatgctggtgacccacactgcgctggacaggaggacctgtttgcagcacgggtcagaggaacacaggctcctccaggtctttccagagcattgactcctgcaagaagtgaatggaagggagccgaaagcctagcccatctccctccttctaccatgatccccagtaagattctggtgtaccgccacccatccagcagaaccggcacagagctttacagacccggcaggcgccgcaagaagtccctgggggacctgttccataatggctaccgggtgaagtctgggcctgctgctccggagaaggaggaaccgccgaacttccggcagtcattggtgtcttgctgtggtgtttgtgcatcctggggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcacc

SEQ ID NO: 10643 - DNA, 709 bp, Homo sapiens
  ENST00000475352
agaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccaggtgaaggaagactgggacccattcccatttttaataactaccctgcagccctcaacattctactttaccatgctgagctcagttgaagaagagcgatgcactactgtggatttcagcttgcacttagcttgttgggcagcaaaataccaaaagggaaaaccgtaaaaaacgattaataataattaaaacgacctcacccccaaactggcagcttgtgcaagacttcagtcggaagccctgttagctagatgcctttgtgttcaaaccactttgcatgactcttattctgagtgactccagtgtgaatatgacattactaatgacctgctaagtgtgtacagatgtgggtttctccagatgtggtgattaataacataatggagatagcggttgactcatgtttatgagttgtttgccttttattacgtttctgagtttatttgctttgaactgttttttaactccagccaataaactcacctttaaatcttaaa

SEQ ID NO: 10644 - DNA, 996 bp, Homo sapiens
  ENST00000450795
agtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgacagtggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaaca

SEQ ID NO: 10645 - DNA, 1355 bp, Homo sapiens
  ENST00000638249
tcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaaattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgaagccgaaagcgtatattaattaatcctggaaaccatcttaagatccaagaaggtactttaggatttttcatcgcaagtgatgccaaagaagttaaaagggcatttttttactgcaaggcctgtcatgatgacatcacagatcccaaaa

SEQ ID NO: 10646 - DNA, 1769 bp, Homo sapiens
  ENST00000640386
gaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaagggtgttcttacatgtcgtggggtgcagaccctgccaacttccatgctgagactcaggaaagaggtttgggcttgaagcttgtatgtcccagagaaagaaaaccctaatgtggagcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgca

SEQ ID NO: 10647 - DNA, 2808 bp, Homo sapiens
  ENST00000640632
aatgagggggttagtcatatgggctttgggcataaaatttgggtgggtggctaagggaccttcatcaacctagcaggagagcaaagtgatcatgttaagacatctcttctgaagtagctcattgacactcttccctcaccttggtggccgctgcgtgcctgattgctaagtgcaccaccgtaacaataacagtctataatggtgatattattaactgcatcgtgcatattattgatttactctttgttctgcatcattatcctttcaccaatgagtttactgcattattctcacatacttagtcaagcaccaaattacaacgaaagggcaggctcttataatggcatctaatggaacattgcataagccatcatcactgcctcctattatgagccacctccagccaatgagctttctgccttagtggaatgtgcacagagcaattatgaagtgcaagggacatggccattctaaattttacccaggaaattaccatgctgcatgttcaccacctgcccaagtctcagagcgcagctagagactcagatgctgtcactatgagcctggggggcacagggacaggagtcgagcctcttgctacatacagtctcttcactagaagccagtggttttatctccacagtcagtccctggctttttgtcttgtggctgactcttgcatcaaatgctcactcctgactgggcattatgtggcacatataagtggccatgacattgcctggtgccaaagtcagattggccaggagccccgagcggttggagggactgtcagtctcaacagttgtggggctcatctcttccgggtgagccactacttccagaaacagaagtccaaaccaccctcaaacaaggcgagcaattccagcctcatcccttcccagcatctccccatcttgaggtaaattcctttagctctcctggaaatcccgggcaccctaaggaagcagccctctggggacgcacagccagctggcatgatcttccattccataggcatcccagccccatttagccctgagtaatgctcacttactgtaaagtgttacatgcccccattgtcggaggagttatagtggaaaaatgcaaaatttcctttttactgcttatggccagcagaacctataacgtgtcaggccgcacattagccaccctgataaaagtctgctttcttacacacaaaatcatcgtttcagcaagatttgttatctcattacctgataagctctatgtcataaaccaagactcatacagtaaatctccccggaggacgctttgtgggcagaaagggagagatatgaatctgcaagggacttgataatgcagcatttaagcacaagcataatgtcacttattgttaaatgcataaaaccacttggccaaacagttgggcttttaataggattttgtgcagcatcaggtgagaagccatatggcttttctgtctaggagtctcagcacctgctagcaccgctgctttgcctcactgccctctggggatgggagctgggcttttatggaggcggagggaggagatgaatgcttcccctgcagctgcctggcttctgctgtcttgccagggggtgggatgcagggtcctgtcgtggtgcctggcctgatctaactggcctctcctgttcaggcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaac

SEQ ID NO: 10648 - DNA, 1012 bp, Homo sapiens
  ENST00000428546
ggcccattttgctgtgtggaggcccatcagaggctgtcactgagtggagcctgctgtcagtgactggcccaccatccagaacggctgactgctgccagccactgcccagccctcggcaggtggctcccttgcagaacgtgttgttctccagccaacggatttggtggtgggcacccaaggtcacattcgcctgtttgtctctggaaaacccaaggacactgaagagataaagcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaa

SEQ ID NO: 10649 - DNA, 2124 bp, Homo sapiens
  ENST00000638506
tcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaagagtggcacatatatctgaagactggggccgtgagatgatctgtcggtgagataactccacctggggccctgcatctgataggcgctcaaaattactacctacttgaaactggacttgttttctgcgctcctatgaaactgaacagtggagggttgctcgtgaaggatctgggacatgtttcatatggagcacaagaaaaggacgtcgaacatgcaacggtctgcatccaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagcctgagagtcttggacttgaattcatcatttatgctaacttatgaactacagttatcctgcatgccttctgtgatgtagacacatttatgaagagtggcataaacccctgcctgtctgattctaagagggcaaaacaaatcttgccagcccctcaatgaaaggaattttaatctgtcttcccatcaagtctga

SEQ ID NO: 10650 - DNA, 2308 bp, Homo sapiens
  ENST00000639120
agcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagctgtaatcacatatggattcttttatatgggtcttggcatggactgaacaaagagaaaggcagcacagaaagattacataacatatacacagagtccggtgcccagcgaggatggggcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaaatttttgactttggttttttgagtgccatccactgttagtgattgttacatgaaaatcgcaaagtcctatgtaagccataaggaataaaatatcagatttccttaa

SEQ ID NO: 10651 - DNA, 646 bp, Homo sapiens
  ENST00000484343
agtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaaatggatgtgatgctga

SEQ ID NO: 10652 - DNA, 599 bp, Homo sapiens
  ENST00000638531
atatggcttttctgtctaggagtctcagcacctgctagcaccgctgctttgcctcactgccctctggggatgggagctgggcttttatggaggcggagggaggagatgaatgcttcccctgcagctgcctggcttctgctgtcttgccagggggtgggatgcagggtcctgtcgtggtgcctggcctgatctaactggcctctcctgttcaggcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacat

SEQ ID NO: 10653 - DNA, 897 bp, Homo sapiens
  ENST00000640311
gcatgtccagagggttgagccctactcagcctcatctgggtactgactgggggccaggactcaggtccagccagtttcacagcagagcctgtgctcttggccatgatgataatggcactttcccacccagtccttttttttttcaaatttatttattttgagtgctgcattctctaccttttatagttaagaatgttttcaaggtctggtgggaggttttcgtgttttgcatccatgaatgcagtcagtgtttgcctgtaaatagggagggtcaattctcttgggctcctctgctgtgcacctcattgcccatagaatgctactctcggatcttgcactagagcactggatgatgaagtgaagccttgcagagacctgtgagtctgggggaggaaaccaagactccagggtggagtgattggctgtatgtttcacctgcagccacgcgaggcccagaagtcttccagtgctttggaggttcacaagaaatatggtgactcaactggaaccacattagaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttc

SEQ ID NO: 10654 - DNA, 645 bp, Homo sapiens
  ENST00000640824
agctgaagaggggagagagacaccctccccacccccatatgaggatggtctgtgatgatatgcatgcaggggaagggacttatccaaggtccctgatagatagggactggaattttggcagtgtcttttctagagtagaacaaatttatcagttgaatttgctgtagttctctgaaggtttctttggccacattagaatttttgagccctggcatccaagtaggccaacttcaaaatggctgtgtgctccactcagagattctgctgtgaagactggcaggagattttttagcctattctgaactccaactgttccagttcctcttgctttccagaggtgtgagcacctggaagcccctgctctggtctacaccccaggctcaagattcatcctgctcactcagccactcatgctgtcaccagtgataaaactgttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtgga

SEQ ID NO: 10655 - DNA, 2507 bp, Homo sapiens
  ENST00000639282
gcatgtccagagggttgagccctactcagcctcatctgggtactgactgggggccaggactcaggtccagccagtttcacagcagagcctgtgctcttggccatgatgataatggcactttcccacccagtccttttttttttcaaatttatttattttgagtgctgcattctctaccttttatagttaagaatgttttcaaggtctggtgggaggttttcgtgttttgcatccatgaatgcagtcagtgtttgcctgtaaatagggagggtcaattctcttgggctcctctgctgtgcacctcattgcccatagaatgctactctcggatcttgcactagagcactggatgatgaagtgaagccttgcagagacctgtgagtctgggggaggaaaccaagactccagggtggagtgattggctgtatgtttcacctgcagccacgcgaggcccagaagtcttccagtgctttggaggttcacaagaaatatggtgactcaactggaaccacattagaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaagtgagtattcaaatatactttcttgccctcgtttcataaacaatcatgagcctttacattgatccatttatttaccttgacaccaacctttgcaagaccttctgagtgcagaagattttggaggaagctagtgctgtactgtactgattttctaaatgggaaagaaagttctcagaaggaaggctattttgagtctgctggcataggagggtgaggtatatgaggtcaagtcttcttgctgggtattacttatttttaaagagctgtttcctaatgatgtatttgcactgaagatgtcaagtagttaagatgacttgatgggaatttgcaacttctgggagggtgacagtttcccacagatgagggtctgagccattcttgctatggttgtaggatccttttctcaattgggtttccaatgctttgatcttactggaggtcagattagaaagcatgatgctatcctttcacctgccaatcgggtattcagctgaagcattgcacgctggtgcttcttgacttgtgaaggtaaggagatggatggaggagttcatcatgacccccagaggtggaggccctggccatttgaggacttctagagtggacactcatgcagactccttgggtgccagccgaatggactggtgctccagagtgagcctgggtgacagatgataaagaccttgcagaaggatgaagagggcacagactagaactgcaatgttgcagccagttctgccctgattcctgcaggtgccaaccctgaggaaataatttgttccaactatactattgcaaatcatgaagttgatggcatctgggaaacaagctggagtctaactcattttctgttgtggcgtgaacttggcaactctggtgacaatggccttgagcttgttgcctttattgtccactgtgtgagtgttttgaactttaaactctatccctggcatggttggctactagactttgatactaggaaacctgcttggtgtgcctgttggctcagactctggtgtgcctgaattctgagcttagtgctcctttcctgtggcttgggatggtggtaatttcatgcacagctaaactcagaatttctcagagccatctggtcaccggccaaggattttgtgcatttgggtggagaggccaaaatgtcagtcagggaaaacaaagcaaatatctcctttaataacctgtctctgggaatcagccaagtttaagcctatcagaggtccttcagcccaccccacatgcgaggctgggctgccctcacccatctcagatggagagtcctttaaacgctgtcaggagacaagattccacatgctccctccatcagctctcccgagccaagaaagagaagagcttgtttaagtttggaagactcccattggcatgtcattgaaggtaagcccccttttaaatatttactgttaatgattctggatcctatttgtattgaactgaagatcctctaaagcccctggtcttatttctccaatctctctccaggggtgttcttacatgtcgtggggtgcagaccctgccaacttccatgctgagactcaggaaagaggtttgggcttgaagcttgtatgtcccagagaaagaaaaccctaatgtggaggtgagtgtgttgatgggttagaagtccagatgcctcagccagcaccttccttcccttttcgtttttttattttttttatttttttaaccttttgtccctctgtatttctcagaaataaaatgctctttagatgg

SEQ ID NO: 10656 - DNA, 1866 bp, Homo sapiens
  ENST00000639204
gaacacaccagtctggaaaagtgaagccagccaggttcagtgtgggtggagtctcccaccagggatcccaccctagcactaaccagggttgaggtgctggggaaaatgaaaagcattggtgtctttctgacccacctaggttgtcttagtctttgctctcagcatcggtgcacttgtaatatacttcatagattcatcaaagtgagtattcaaatatactttcttgccctcgtttcataaacaatcatgagcctttacattgatccatttatttaccttgacaccaacctttgcaagaccttctgagtgcagaagattttggaggaagctagtgctgtactgtactgattttctaaatgggaaagaaagttctcagaaggaaggctattttgagtctgctggcataggagggtgaggtatatgaggtcaagtcttcttgctgggtattacttatttttaaagagctgtttcctaatgatgtatttgcactgaagatgtcaagtagttaagatgacttgatgggaatttgcaacttctgggagggtgacagtttcccacagatgagggtctgagccattcttgctatggttgtaggatccttttctcaattgggtttccaatgctttgatcttactggaggtcagattagaaagcatgatgctatcctttcacctgccaatcgggtattcagctgaagcattgcacgctggtgcttcttgacttgtgaaggtaaggagatggatggaggagttcatcatgacccccagaggtggaggccctggccatttgaggacttctagagtggacactcatgcagactccttgggtgccagccgaatggactggtgctccagagtgagcctgggtgacagatgataaagaccttgcagaaggatgaagagggcacagactagaactgcaatgttgcagccagttctgccctgattcctgcaggtgccaaccctgaggaaataatttgttccaactatactattgcaaatcatgaagttgatggcatctgggaaacaagctggagtctaactcattttctgttgtggcgtgaacttggcaactctggtgacaatggccttgagcttgttgcctttattgtccactgtgtgagtgttttgaactttaaactctatccctggcatggttggctactagactttgatactaggaaacctgcttggtgtgcctgttggctcagactctggtgtgcctgaattctgagcttagtgctcctttcctgtggcttgggatggtggtaatttcatgcacagctaaactcagaatttctcagagccatctggtcaccggccaaggattttgtgcatttgggtggagaggccaaaatgtcagtcagggaaaacaaagcaaatatctcctttaataacctgtctctgggaatcagccaagtttaagcctatcagaggtccttcagcccaccccacatgcgaggctgggctgccctcacccatctcagatggagagtcctttaaacgctgtcaggagacaagattccacatgctccctccatcagctctcccgagccaagaaagagaagagcttgtttaagtttggaagactcccattggcatgtcattgaaggtaagcccccttttaaatatttactgttaatgattctggatcctatttgtattgaactgaagatcctctaaagcccctggtcttatttctccaatctctctccaggggtgttcttacatgtcgtggggtgcagaccctgccaacttccatgctgagactcaggaaagaggtttgggcttgaagcttgtatgtcccagagaaagaaaaccctaatgtggaggtgagtgtgttgatgggttagaagtccagatgcct

SEQ ID NO: 10657 - DNA, 2963 bp, Homo sapiens
  ENST00000480683
cccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaagagagtgagccagctgccttctttctgagtaattcccatcctaggggacttcacgcgcgaaccgttttggagggaagggaaatccaggggaatagtgcagggtagatacacattgcagcctccacatgttcacatcttttctagtaaagttaaaccgaggacccctcaaacttctacagggcacagcaacttgtagcagcctccttggcggctgagagaagtagggaagcctggggctatgggtgaaggctggctatgaaaacaccaggggggaaggagcctgtctctcctgatcattaattatacatcctgttgggtgctggagctcagctgtgttttgtggcagcacatttgtgttttggaaaatactggtgtattggaacaaagggagaaatatgaaaaccatcattctcttcgtcattctctggcttctccggaggcctgcaggtgctggtcggagagttttctttggaattaccttctcagccgtagaggtttcttcttatttgttaaggaggcaaacctcccaccttccagagaagccctcaggttaagcaaagccctatacaccagatccctgactagccttcctgctgagaacagcttattcctggagccttcaaattcccacattccctctctccatccttctcctccacctcccccaacagtctcgggaattttgttccccggtttactgagattcagcgactgtctttaggggaaagatagctcatagttgtgtgcctctgaaatgttccctagatagagtgatctgggtgaactttttaacagcttgctttctttcaggcagggggcaatttttatcataatgaaaactttttccatgattgaaaataagttgtggtgtttttgtgaacctggggtcctaaacacagcttccaaagtctttttatgttagggggtacataaatgcaattgcagtgtctgtaatgaaatgctaatcccatcgcacacacaaaggatctcctaaatgatgagcaagcataacttctgtcagtttactcaagaaaataggtttttggcaacgattagaaaaaacaattcgtaaatatttggctatgttttgtagccccaagacctgctgagtggacataactggaagtgagttgctgtaagaaatctgccagggatgagaggtgatggtggtttgtttggaagatgtgaggccagtatagaatgagtgcaggttccttttgataccgtaagtccattttaaagcacacctagaatctcttgatacctgcccctagatttgctcacttaagccataggtagccagctcattatatgcagtaacggtaagttaggccttttaaaagcttttctttctatgcttgaggtctgtatttttattgcaattgtgtgtgtgtgtgtgtgtgtgtgtgtgtgtgtgtttgtctttttttcttttttctttccaagtatttggtagttttgtcaagactcgatacacaggcatgtatttggcttaagcttagaataataatttttgtgctagatttcccaagaaaacataggctgcctttccagaaaattctaccagccctcagatgggttcaccctcaccctccttcagccccaagatggtttgatcaagagctggagtccagaggaaagcaggtctgaaattctgtgggagataaaattcagcaaggagctccaatttcatgagcgtttggtctctgggatcgcaccaaacctttttgatcaaaggaacccaagactgtggacatgcatcgtgggacatctcttcattagtacctttggcctctgaatctcaaacagtgaatgactttagtcttttgaaaagagtggcatgtggactttttcagaaagtgaagaagaaaacattacaatttcctcctgttgggaacttggtcacagtcattccagtactgtgttctttgctgtactttttcacattattgtttttttccttgtgggatttcatcagagctctctattcacttgggtgtgacgttgtgaagttcaatcctgtcatagactatattgaatagggagctgctctggtagcctgaataaagccatgactttgaagaagtta

SEQ ID NO: 10658 - DNA, 1269 bp, Homo sapiens
  ENST00000618048
atggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaa

SEQ ID NO: 10659 - DNA, 896 bp, Homo sapiens
  ENST00000481070
ggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaa

SEQ ID NO: 10660 - DNA, 5639 bp, Homo sapiens
  ENST00000406533
aggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctgatatattttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttt

SEQ ID NO: 10661 - DNA, 5732 bp, Homo sapiens
  ENST00000354353
aggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgttgggaagaacattgttctttgtggagactggaaagcaagggaaatgtgagaagattaaactactgcaggggtcagcaaactttctctgtcaaagtcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttt

SEQ ID NO: 10662 - DNA, 13033 bp, Homo sapiens
  ENST00000271915
ttgagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgactaaaaccaaaaaaccaaaaa

SEQ ID NO: 10663 - DNA, 532 bp, Homo sapiens
  ENST00000515643
gcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtgcctctacttgggagcgggaagaggagatgacaggaagcgacgcctctggcagggcccttgctgcagagttggtggagaacagaaatccacgctcaatctcaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatat

SEQ ID NO: 10664 - DNA, 1962 bp, Homo sapiens
  ENST00000361147
caggaaagtcagcttaaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 10665 - DNA, 1658 bp, Homo sapiens
  ENST00000358505
gaggactcagaataaacctgctgctgcttcgtaaacatctcctgataaaaatggctacaggtgttacctgggcagagcagctgggcgccgccttggaatcagctgggggagcacctctccttgggacgggatgacagggcttcccaggcggtccccacaagcccgcgccccagctcagccccagttctcccctcccacctcaactcctccttgggataaataaagatgagtgtgtgtgtgagtgcgcgcccggatggagaacagcaggcactggctttagcggggagctggccccactgctccagcctctcagtccagccccaagacggaggagggggtttccctcccagagggagtggagatggaggaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagca

SEQ ID NO: 10666 - DNA, 13057 bp, Homo sapiens
  ENST00000618040
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaagtcctgaatcaccagcccagccttctggctcatcacttcctgcttggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgctcctgttttcagtgacagttcagctgaacatataagcagatgtgtaaacagatgaagtaaccatgcagtttccttgtggcattagttccatttcacaaagtgaagaccactggtgggctgatctgagtgtgccaatcctgatcatttaaacctacagccttcaactggtgattcctacccaccgttttcattctgctataaccctgtgatatgtgtgcgtgtgggtgtgagtgtgggtgtgtgcacatatagagatttagtcttaatttcaaccaaatgacatgcaagattccactgccactcttcctggccaaaagtgtgcacagactgtgatttattcattgtggtctgtgactttaacccatcattgatgctctcacttaggtaaaccctaaagaccaaactagcaacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggctgcggcaggagaatcacttgaaccccggaagtggaggttgcagtgagccaagatcgtgccattgcactccagcttgggtgaccgagcaagactccgtctcaaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaaccacccccacccctgccattgcttaagccatattaaagcttcatgtactgtaaagtcagggatgtactgtgatactttaagaccactaatctcagtggaatttcaggacatagcattagttggtaaattacaccagactaggggctcactcctccttagattgaagtccaaataaaagtcttcacctttggatcaaaggccacatatatatgatcatcatcaataaattgtcataaagtgtctatgaactgctcttgccatcttcctaatacgtaacttcatgacatcatgtctctagaagtgcttaatacaatccaaaagaacaaggggggaaggccccaagtcaccactgaccgacctcagcaggggccagtggtagaacaacaatcttgtgaattaggagacatagaaaatgtacgcaaaagtaaattccaagcgctgagcatgtacaagctatttttattattaaaagccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaattaacattttgtatcaaactagtgtttagcaggtccactgtcagcctgctctcccaatgactgtttctgagtacacatcactgttagtgattgccgggcacccagaaaaagggtcctcctaccacagcctactgaactgccatattctaattctccaaggcctgggtattagagacaaaagaacattattccaagagtagaggaataattctaccctaaattctatcaagccatttcagaagagattttaaaagccatcactcctttagtagctctgcaaagccagtttaataaaagttcaggctctttctatataaattcaaaggcctcattacataaattatataagtctcaaacctagccaaccagttttcctttgacaatgtcagaattggacataagaaagagtcctgttttcctgtaacttaaaatactcaaaatcctaggcattctgagtttctccatgtacgtgaaaccggggtcggctttccaaactacacaaggcccaacaagagtccagtgtgcagatgtgcttttctaaattggcaatacccttgagggagcaaggttcccacatgtttatcaaggacatggagcccagctcctaagggagtgatgggaggagccggcaggacatgaacagccagagccagcaaagagccgggctgccttttctgctagcttcctctagctgggaggaaataaagggttcccgttgagatattgtcctttatagcaaaattaagcaactcatggaatctacacccctctttctctacagagcagctgagacatacatgtagaagttctcagttccctccttcatatggctaaggcactacttctagatgaaaacaggatgtgttcggttacagaataaagattttctagaatcagtgagcctcttctcacctgggaccctcacttgctgttgttgctttggtgcaatattgtacaggtgcaaaccaggttgcatcggggcagattaactgagcctatgtgtctcttcccttcccaagccctgaaaattcacatagatttacagatagtgcaaaacaacaagttttctcctgggaaaaggctggaatccttcaaatttcaatttatatgagcttaaaggtatataagtcatggggctcactgacattaggtattcatgctgtttgaaagagaaatgtctaaatgcccgttttcagtctgtttgtgtagctgagccctaacttgtacacaagttttcttgttatggagctaaattctctcagtgcctgtattactcctcagttatatgttaggccgagctccactaaagccatctgaactccagggcacttgtttttatcaggttacttactcaccggataatggaaattggcttattttcaattttacaattgactgatgaatgtattggtggtaattgatttatttcttcacttttttttgctactaaatgattttttcttttttaaaattattattattattattttgagatggagtctcactctgtcgcccaggctggagtgcagtggcgccatctcagctcactgcaagctctgcctcctgggttcatgcaattctcctgcctcagcctcccgagtagctgggattacaggtgcgtgccaccacgaccagctaatttttttgtatttttagtagagacagggtttcatcatgttaaccaggatggtctcgatctcctgacctcgtgatccacctgcctgggcctcccaaagtgagccactgtgcctggcccagtaagtgcttttttcttttggtttttccttctaacactgctcagaccaagacttacatttataaagagcaaatatattctgacctttcccctcaaagttgtattccatctagaatcaaggaaacaaatgcaaattcatcatttggggaaagcagacctcttgacagtaattcaagtccatggctatatgctaacccttgctactcaaagtgtggtccacagaccagcagcgttagcatcatctgtaagcttgttagaaatgcagaatctcaggccccacatcaaaccttcttcatcagaattggccttttaacaaatccccaggtgacctgtatgcaccagaaatattgataagcactggcctcacctcaccgtagtgataactaacctcgttaataattagagaatgaagctatctcttccttgagtctcatttacagaattatttgaagatgtgaaggtcctgaatgatcataaggattaaaaaaatgcatctttaaattccacttgaggttatataacttggatggtctacatcaaacataataaagtcaataagagatagtctttttccggtcttacctaaatagcactccatatccttgagccacctcaaagcccccatttttaagttttagtctttttttttttagaccagactagcaaagccatcagaatatcaggtggaacctcagggcaggtcctctggaaggctacaggagtctctgcttagcatagtacagaaattgttgtgtttctcgatccttgtgttcttcccttgaggaactcagcatctcaccagtaagaactcccctcccctagaggaaaatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaacttgctctggttagaagtccctagagctccaggaagagtcgccaggtttccattgctgtgctcaaagctcaaggacacattatacttctttaaaccaactaaatctctctagctccctgcccccatggtgacactttcataataggcagggccaagtcagagaggtcatgccctgtatacagtgtcaatcagaagagacactgcaaaatgtcagaggtgaccagaaagacaacagatctctccagctgtcctcacagctgcaggcacatttgtggaattgtgagtaggaaggcttggcagccaggggatgggaaatgaatttccccaagttgaaaaccctgtacccttactttccttcccataaatttttctgtagttctaggtaaataataataataataaaaatgcaaattaggtgctttagaaggagtatgtaatatctgggactttttctaagttggtagacctaaaaaatgttttcaaaaatatatctagctgcatttctactgctgtcattccttaaagctcttcctccaaaaactccatatgaatgaatacatttaccaactcagtgattactaaataatagtactttatacttatacacagtaatacctttcatctaaggatctcaaatgccaatatattagtcatcaccctgtaaggtggatgacatattattcccattattccaatgggaaaattgggccatagaaaactgaggagcaaatgactcatctacaggaattaaatggaaaaaacaggctaggatttctcagcacactttaggagtgaatgaaaacttacaggcttcagttctactgctggccaccattggatttgtaagatccaggatgtgtattgaccacatgtgtccagacccaggcttagggcatctggaatgagagtggtgggctggtgtgtgggtctgaggatctggatgggagactgcattttcttctctgtgcaaaatatggaagtgtgaccttgaaggtgggcttagtctatggccttccccactcctgcttgaactgaagctggagagaatgggcatttttaaatgttacggcatatgctaatataatattatggcattaaataaaaacaagaagagaactgact

SEQ ID NO: 10667 - DNA, 11510 bp, Homo sapiens
  ENST00000388996
cgggtgggagcgcggaggagggaggaggcggcggcggcggcgcgtgtggctggcgggcgggagggcggctggcaccgggcttgtaaataaactgcgatgctgtcttgggctcgccggcctgggtgccgccgccgccgccgccgccccggagcgccggttccaggctcccgccgccgcgcgccctagcgcctccgcgccagcctcgcgcgccctcccagcttctccgcagcccccggcccgcgaccctcggggtcctgcggctgacccgcgcgggatgtgaccccctgaccccctgcctggcctcccctgccccccagggggcccgcctttgcctgcttttgggggggggtggggaggggcgcgcggatcatggcattggagttcccgggcttgcagccgccgccgccgcctcgttcacgcaccccgagcgccccttcttcccagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaaaagagaaaaatgatcttctggaataactctgctttgatattctccttttgttccccaaaaaatatattccagaaaggcaaaccaaacctgctcaagttgcctatgcacagacaatctcaacaatatggctcacagtgagcaagcagaaattcagggtctggaattgaatgtgagttatgggaagaaacagtgtgtgctttcacaaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaattagataaatcaacttcacaaatgttaagcgaaacatgatcctattgagctgagaaagaagtacttgagatcgtttgagttttgactatcaaatgtcagcacaaaagcaaatatcaaaagcttaagaaaaaaattatttcaggaaaagaaaaacacatcaaattgagaaagtgttgttgaataactttgtttttagaactggaaatttaggcttattagacatgacattgatattacaaagccctagttttcatgaaaacataactagataaccccaaggtgtataggttaaaatgaactaattaatcaacaattatgcatcctgtgtctattttgtgcaaggtacttcctagacactgtagtttgaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaaggttctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgaccaagagaagcttatgatacagactatgacacagcacctatttcaagagaaagatgttactctacttatgggaacctgcagatcaaattctcctggggcaagagaagaaatttgttcagcagcctaagaagtcaactgtactttggacagtgctgccaaacacaccccaggattctcccacccctgtgctttcccagaagatgccacatagctggtatttggttttcatgaataaccaaagattcttctttgcttcctgaaccccaggcatccttaggaatttgcttcatgtcctcacttgtccttgaaggcttgtttttcaggatgaacttttaaagtctaagttgtttatattcaaatcaacccaatgctattgttgctgatattaaaccattccaaactgagccaactggcccctaaacaagccagcaggcagcccctcactaatgcccagtttagaacatgttaggaccaggctatctgcatagctttagtggttttagaagccagtaatggcagtgtaaaagaggaatcatacagagatgacctggaagaaaatttgagtttcagcacattcaaaagcatttgactcttctgccgtgttttgattttcaagtgagacaatcaatgtacacacaaagcctctagtacaatgactgatgcatactagggactgttatttatgttatttttttacagtatgcatggacttcattgtctcagtctttggtgttacttataaactctaaatttacaccaaaaaaattttttttcagaaaaagaatcgtggagaaacaatcctaattattaaatcaaatgctttcacaattgctttttaaataagtacatctctgcaaataaaaatgcttgctcttgtctaccacaataaagaacagaaggaatcttggaatgaagagaggcaggaatgttggatctcagtggctgagttgtggcaattccattggacatatagtaccagatgttgcaccatctggatgatgtgtaggagataaagccaaattgcaaaaataaaagactcatgatttcccaaggaaagtcaactgtgcatggtggctatcagacaacaccctagcaatgaatgggggaacttgcagaagaaagagttaatgcttgcttaaaccttccctggggagatttgttcccaggctttcacggctttaacctcagcaaccctgtaagaaaattgtgattcatattttgatttgttatcatagatgcaaagagacataatttcatggattctaagatacacagagcaagaagagattttgatcacccagaacaaccacctgtctttttagatcaagaagcagaagctcagagcaaagaacatcacaccacgtccctcagtgattgaagcagtgattgagtcacagaataaatctggaactcaggtcttctgatctttgctccagatgttagagacaaaactaaaagtaaaataccaagtgaaatcaaagcatcacgattgagcccagaacatgaaaaagaacttcctggcccacttgagaaactgttaaaccggacatacctttggggacttcttcccttctctggaataagattgatgtttccatgctgtgaaagacgatgatgttccttctcccagattcctgctgtcttcaaaaggcctagcaaaaaccactgctgctgggtgcagttgagaaagggaatgaagaacaatcccatggccatgcaggcactcctcccctccacctctctgccctccacccctctgccctctcctaccttgttccttcttggtcctgccatgtttggactggttcacctttttggcccatcacttgggctcattcagcaacagtcatgccttaggttgcatcctcatctataggccaattaaacagggtttcttcttgataaatccctatggttttgattttaggaagtcaggcatgatttcttttgggatctatatgacccaaagtggccagttttaccaaaggtgtccctttgcactgggatctctgggtctcatttgaacacagcttgggtcctcttgccttgtcccagagaatccccatgttgtcaggacataagcagatactctagggccttcaccaaaagctacaaagaagcagacaggactcaacttaggacatcttatggttatgtaactaagagattattttaggaagtaaacaggcctctgttggctcaaatgaacatcttcattgttagtttccacttacattgttctcgggataaatcggccagaatttggcagggctccccagcagtccttgtgaatccctgtggtaggatgtttcagttctcctgagtcaggctgaagtgaaagctcctaagagatattcagaaagaaggatggtcaagttctagaacaacaatagttggcccagtaattttaaagattgtcattctacctaagccttcatcctccagatagcactgttatgggcttaaaataagcttcaagggaaataatgaatttctttgacaccgccaaaaatcggctgtatataagaataacttgagaatggcttacaatgaggtagtcaaaagcccagctcagtgctcaggaatgtatttgtaattcctcttagacttgtcgaatggactgcaatttgatacctaagagtaataaaaaatgagaccatattttatgttaatgttcccttctcttcctctgcccacaaaagtgaggtcagggaaggggagagaaacttatcctaagcactccttatgagttgcttgtgacatgatagctctctctaaagttcatgcaatcctcatcgcaaccccatgagggagatgttattgtctccatcttatagatgaggaaactgaagacaagaccttgtcaaaggtcacacattgtaagaagtagagctgcatattcaaccaaagcccgtgtacctggaaagctcattctctctcccccttcttcctctcaaatcaggccctagctcctccacaatgcttcgggcttctacgttcactcagctttacagtaaaatgatcacagacccatgagttccctggagagtagagtgatgcctgggtcagctgttcctcttgtctgttcagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgatta

SEQ ID NO: 10668 - DNA, 4943 bp, Homo sapiens
  ENST00000639496
aaacagaagcaggagggccatggtggcacaggcatggaggacctcaatgaggaagcagagggaggaagcgtgtttcaggttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcc
